US007763420B2

(12) United States Patent
Stritzker et al.

(10) Patent No.: US 7,763,420 B2
(45) Date of Patent: Jul. 27, 2010

(54) METHODS AND COMPOSITIONS FOR DETECTION OF MICROORGANISMS AND CELLS AND TREATMENT OF DISEASES AND DISORDERS

(75) Inventors: Jochen Harald Stritzker, Kissing (DE); Phil Hill, West Bridgford (GB); Aladar A. Szalay, Highland, CA (US); Yong A. Yu, San Diego, CA (US)

(73) Assignee: Genelux Corporation, San Diego, CA (US)

( * ) Notice: Subject to any disclaimer, the term of this patent is extended or adjusted under 35 U.S.C. 154(b) by 0 days.

(21) Appl. No.: 11/827,518

(22) Filed: Jul. 11, 2007

(65) Prior Publication Data

US 2008/0193373 A1 Aug. 14, 2008

Related U.S. Application Data

(60) Provisional application No. 60/852,389, filed on Oct. 16, 2006, provisional application No. 60/830,422, filed on Jul. 11, 2006.

(51) Int. Cl.
*C12Q 1/00* (2006.01)
*C12Q 1/66* (2006.01)
*A61K 39/108* (2006.01)

(52) U.S. Cl. .............. 435/4; 424/9.1; 424/9.2; 424/234.1; 424/241.1; 435/8; 435/29

(58) Field of Classification Search .......... 424/9.1, 424/9.2, 234.1, 241.1; 435/4, 8, 29
See application file for complete search history.

(56) References Cited

U.S. PATENT DOCUMENTS

| | | | |
|---|---|---|---|
| 4,442,203 A | 4/1984 | Varshavsky | 435/6 |
| 4,722,848 A | 2/1988 | Paoletti et al. | 424/199.1 |
| 4,778,759 A | 10/1988 | Szalay et al. | 435/477 |
| 4,870,172 A | 9/1989 | Okami et al. | 540/460 |
| 4,912,199 A | 3/1990 | Lown et al. | 530/331 |
| 5,221,623 A | 6/1993 | Legocki et al. | 435/252.3 |
| 5,300,436 A | 4/1994 | Goldstein et al. | 435/190 |
| 5,550,050 A | 8/1996 | Holland et al. | 435/382 |
| 5,554,507 A | 9/1996 | Grossman et al. | 435/32 |
| 5,639,275 A | 6/1997 | Baetge et al. | 604/891.1 |
| 5,646,298 A | 7/1997 | Powell | 548/427 |
| 5,650,135 A | 7/1997 | Contag et al. | 424/9.1 |
| 5,650,148 A | 7/1997 | Gage et al. | 424/93.2 |
| 5,653,975 A | 8/1997 | Baetge et al. | 424/93.1 |
| 5,656,481 A | 8/1997 | Baetge et al. | 435/325 |
| 5,676,943 A | 10/1997 | Baetge et al. | 424/93.21 |
| 5,693,533 A | 12/1997 | Raney et al. | 435/366 |
| 5,704,910 A | 1/1998 | Humes | 604/502 |
| 5,710,137 A | 1/1998 | Fisher | 514/44 |
| 5,800,828 A | 9/1998 | Dionne et al. | 424/422 |
| 5,833,975 A | 11/1998 | Paoletti et al. | 424/93.2 |
| 5,976,796 A | 11/1999 | Szalay et al. | 435/6 |
| 6,025,155 A | 2/2000 | Hadlaczky et al. | 435/69.1 |
| 6,045,802 A | 4/2000 | Schlom et al. | 424/199.1 |
| 6,077,697 A | 6/2000 | Hadlaczky et al. | 435/172.3 |
| 6,080,849 A | 6/2000 | Bermudes et al. | 536/23.7 |
| 6,093,700 A | 7/2000 | Mastrangelo et al. | 514/44 |
| 6,099,848 A | 8/2000 | Frankel et al. | 424/246.1 |
| 6,106,826 A | 8/2000 | Brandt et al. | 424/93.2 |
| 6,190,657 B1 | 2/2001 | Pawelek et al. | 424/93.1 |
| 6,217,847 B1 | 4/2001 | Contag et al. | 424/9.1 |
| 6,232,523 B1 | 5/2001 | Tan et al. | 800/10 |
| 6,235,967 B1 | 5/2001 | Tan et al. | 800/10 |
| 6,235,968 B1 | 5/2001 | Tan et al. | 800/10 |
| 6,251,384 B1 | 6/2001 | Tan et al. | 424/93.21 |
| 6,416,754 B1 | 7/2002 | Brown et al. | 424/93.21 |
| 6,447,784 B1 | 9/2002 | Bermudes et al. | 424/235.1 |
| 6,491,905 B1 | 12/2002 | Sorscher et al. | 435/325 |
| 6,503,703 B1 | 1/2003 | Palese et al. | 435/5 |
| 6,511,967 B1 | 1/2003 | Weissleder et al. | 514/44 |
| 6,548,068 B1 | 4/2003 | Schlom et al. | 424/199.1 |

(Continued)

FOREIGN PATENT DOCUMENTS

| | | |
|---|---|---|
| DE | 102 09 958 | 11/2006 |
| EP | 0861093 | 9/1998 |
| EP | 1 281 767 | 2/2003 |
| EP | 1281772 A1 | 2/2003 |
| EP | 1 489 164 | 12/2004 |
| EP | 1512746 | 3/2005 |
| EP | 1526185 | 4/2005 |
| JP | 2002097144 | 4/2002 |
| WO | WO 88/00617 | 1/1988 |
| WO | WO 96/40238 | 12/1996 |

(Continued)

OTHER PUBLICATIONS

Yu, Y.A., et al. Anal. Bioanal. Chem. vol. 377, pp. 964-972, Jul. 2003.*

(Continued)

*Primary Examiner*—Rodney P. Swartz
(74) *Attorney, Agent, or Firm*—K & L Gates LLP; Stephanie Seidman

(57) ABSTRACT

Described herein are methods for detecting a microorganism or cell in a subject and methods for detecting, imaging or diagnosing a site, disease, disorder or condition in a subject using microorganisms or cells. Also described are methods which use microorganisms or cells for treating a disease, disorder or condition. Such sites, diseases and disorders include sites of cell proliferation, proliferative conditions, neoplasms, tumors, neoplastic disease, wounds and inflammation. Further described are microorganisms and cells for use in the methods and compositions, combinations and kits, including diagnostic and pharmaceutical compositions, containing a microorganism or cell. Microorganisms and cells described herein include those that bind, sequester or accumulate metal, such as those that provide for metal acquisition, transport, storage and/or metabolism. Additional imaging and therapy agents are also described.

91 Claims, No Drawings

U.S. PATENT DOCUMENTS

| | | | |
|---|---|---|---|
| 6,559,130 B1 | 5/2003 | Sukumar | 514/100 |
| 6,589,531 B1 | 7/2003 | Andino-Pavlovsky et al. | 424/199.1 |
| 6,596,279 B1 | 7/2003 | Paoletti et al. | 424/199.1 |
| 6,623,721 B2 | 9/2003 | Flanagan et al. | 424/1.65 |
| 6,649,143 B1 | 11/2003 | Contag et al. | 424/9.1 |
| 6,649,159 B2 | 11/2003 | Yang et al. | 424/93.21 |
| 6,652,849 B2 | 11/2003 | Brown et al. | 424/93.2 |
| 6,685,935 B1 | 2/2004 | Pawelek et al. | 424/93.2 |
| 6,743,967 B2 | 6/2004 | Hadlaczky et al. | 800/25 |
| 6,759,038 B2 | 7/2004 | Tan et al. | 424/93.21 |
| 6,916,462 B2 | 7/2005 | Contag et al. | 424/9.6 |
| 6,939,691 B1 | 9/2005 | Khosla et al. | 435/76 |
| 6,962,696 B1 | 11/2005 | Bermudes et al. | 424/93.4 |
| 6,984,374 B2 | 1/2006 | Szalay et al. | 424/9.1 |
| 7,045,313 B1 | 5/2006 | Moss et al. | 435/69.1 |
| 2001/0008025 A1 | 7/2001 | Hadlaczky et al. | 800/8 |
| 2001/0029023 A1 | 10/2001 | Szalay et al. | 435/7.1 |
| 2002/0054865 A1 | 5/2002 | Fujimori et al. | 424/93.21 |
| 2002/0058326 A1 | 5/2002 | O'Sullivan et al. | 424/93.4 |
| 2002/0160410 A1 | 10/2002 | Hadlaczky et al. | 435/6 |
| 2002/0160970 A1 | 10/2002 | Hadlaczky et al. | 514/44 |
| 2003/0009015 A1 | 1/2003 | Ulrich et al. | 536/23.1 |
| 2003/0031628 A1 | 2/2003 | Zhao et al. | 424/9.6 |
| 2003/0031681 A1 | 2/2003 | Mc Cart et al. | 424/186.1 |
| 2003/0033617 A1 | 2/2003 | Hadlaczky et al. | 800/6 |
| 2003/0044384 A1 | 3/2003 | Roberts et al. | 424/93.2 |
| 2003/0059400 A1 | 3/2003 | Szalay | 424/93.2 |
| 2003/0083293 A1 | 5/2003 | Hadlaczky et al. | 514/44 |
| 2003/0101480 A1 | 5/2003 | Hadlaczky et al. | 800/278 |
| 2003/0133949 A1 | 7/2003 | Szalay et al. | 424/200.1 |
| 2003/0161788 A1 | 8/2003 | Zhao et al. | 424/9.6 |
| 2003/0186848 A1 | 10/2003 | Gorringe et al. | 514/6 |
| 2003/0198627 A1 | 10/2003 | Arts et al. | 424/93.21 |
| 2003/0219385 A1 | 11/2003 | Ahrens | 424/9.322 |
| 2003/0228261 A1 | 12/2003 | Szalay et al. | 424/9.34 |
| 2003/0228330 A1 | 12/2003 | Falkner et al. | 424/232.1 |
| 2004/0143861 A1 | 7/2004 | Hadlaczky et al. | 800/14 |
| 2004/0186087 A1 | 9/2004 | Grafe et al. | 514/185 |
| 2004/0191233 A1 | 9/2004 | O'Sullivan | 424/93.4 |
| 2004/0213741 A1 | 10/2004 | Szalay et al. | 424/9.6 |
| 2004/0234455 A1 | 11/2004 | Szalay et al. | 424/9.6 |
| 2005/0025745 A1 | 2/2005 | Fujimori | 424/93.2 |
| 2005/0031643 A1 | 2/2005 | Szalay et al. | 424/199.1 |
| 2005/0063993 A1 | 3/2005 | Schlom et al. | 424/199.1 |
| 2005/0064447 A1 | 3/2005 | Huang et al. | 435/252.3 |
| 2005/0069491 A1 | 3/2005 | Szalay et al. | 424/1.11 |
| 2005/0249670 A1 | 11/2005 | Szalay et al. | 424/9.32 |
| 2005/0255088 A1 | 11/2005 | Bermudes et al. | 424/93.2 |
| 2005/0287641 A1 | 12/2005 | Farnet et al. | 536/23.1 |
| 2006/0019876 A1 | 1/2006 | Faulk | 514/6 |
| 2006/0051370 A1 | 3/2006 | Szalay et al. | 424/199.1 |
| 2006/0134801 A1 | 6/2006 | Chada et al. | 436/177 |
| 2007/0025981 A1 | 2/2007 | Szalay et al. | 424/130.1 |
| 2007/0202572 A1 | 8/2007 | Szalay et al. | 435/69.1 |
| 2007/0212727 A1 | 9/2007 | Szalay et al. | 435/6 |
| 2009/0053244 A1 | 2/2009 | Chen et al. | 424/174.1 |
| 2009/0081639 A1 | 3/2009 | Hill | 435/5 |
| 2009/0098529 A1 | 4/2009 | Chen et al. | 435/5 |
| 2009/0117034 A1 | 5/2009 | Chen et al. | 424/1.17 |
| 2009/0117047 A1 | 5/2009 | Szalay et al. | 424/9.3 |
| 2009/0117048 A1 | 5/2009 | Szalay et al. | 424/9.3 |
| 2009/0117049 A1 | 5/2009 | Szalay et al. | 424/9.3 |
| 2009/0123382 A1 | 5/2009 | Szalay et al. | 424/9.6 |
| 2009/0136917 A1 | 5/2009 | Szalay et al. | 435/5 |
| 2009/0155287 A1 | 6/2009 | Chen et al. | 424/158.1 |
| 2009/0162288 A1 | 6/2009 | Chen et al. | 424/9.3 |
| 2009/0180955 A1 | 7/2009 | Stritzker et al. | 424/1.73 |
| 2009/0180987 A1 | 7/2009 | Stritzker et al. | 424/93.2 |

FOREIGN PATENT DOCUMENTS

| | | |
|---|---|---|
| WO | WO 97/18841 | 5/1997 |
| WO | WO 98/14605 | 4/1998 |
| WO | WO 00/73479 | 12/2000 |
| WO | WO 01/12234 | 2/2001 |
| WO | WO 01/14579 | 3/2001 |
| WO | WO 01/18195 | 3/2001 |
| WO | WO 01/24637 | 4/2001 |
| WO | WO 01/25399 | 4/2001 |
| WO | WO 03/006069 | 1/2003 |
| WO | WO 03/045153 | 6/2003 |
| WO | WO 03/057007 | 7/2003 |
| WO | WO 03/063593 | 8/2003 |
| WO | WO 03/092600 | 11/2003 |
| WO | WO 03/102168 | 12/2003 |
| WO | WO 03/102169 | 12/2003 |
| WO | WO 2004/030631 | 4/2004 |
| WO | WO 2004/044175 | 5/2004 |
| WO | WO 2004/069178 | 8/2004 |
| WO | WO 2005/034949 | 4/2005 |
| WO | WO 2006/048344 | 5/2006 |
| WO | WO 2008/099001 | 8/2008 |

OTHER PUBLICATIONS

Office Action, U.S. Appl. No. 10/485,179, mailed Nov. 19, 2007.*
Office Action, U.S. Appl. No. 10/866,606, mailed Nov. 27, 2006.*
Office Action, U.S. Appl. No. 10/866,606, mailed Mar. 18, 2008.*
Office Action, U.S. Appl. No. 10/516,785, mailed Jan. 28, 2008.*
Office Action, Canadian Pat. Appl. No. 2,456,055, issued Oct. 4, 2007.*
International Search Report and Written Opinion, PCT/US2007/01589, issued Sep. 11, 2008.*
Yu et al, "Establishment and characterization of conditions required for tumor colonization by intravenously delivered bacteria", Biotechnology and Bioengineering, vol. 100, No. 3, pp. 567-578, 2008.*
Yu et al., "Examination of bacterium-mediated detection of tumors in mice models". In, Proceedings of the 14th International Symposium on Bioluminescence & Chemiluminescence: Chemistry, Biology and Applications. World Scientific: Singapore, pp. 209-212, 2007.*
International Search Report and Written Opinion, corrected version, International Pat. Appl. No. PCT/US2007/015826, Jan. 13, 2009.*
International Preliminary Report on Patentability, International Pat. Appl. No. PCT/US2007/015829, Jan. 29, 2009.*
Loessner et al., "Drug-inducible remote control of gene expression by probiotic Escherichia coli Nissle 1917 in intestine, tumor and gall bladder of mice", Microb. Infect. Published online: Aug. 7, 2009.*
Westphal et al., "Containment of tumor-colonizing bacteria by host neutrophils", Cancer Res., vol. 68, No. 8, pp. 2952-2960, 2008.*
"Identified virulence factors of UPEC: Iron Uptake," http://www.mgc.ac.en/cgi-bin/VFs/vfs.cgi?Genus=Escherichia&Species=UPEC&Keyword=Iron%20uptake (accessed on Jan. 12, 2006).
"Mutaflor, The probiotic drug for life!", http://www.ardeypharm.de/download.php?id=10000, (downloaded on Apr. 16, 2008).
"Vion and Memorial Sloan-Kettering Cancer Center Present Data on Tapet's Potential to Enhance Imaging of Solid Tumors" Press Release, Vion Pharmaceuticals, Inc.(2000).
(Bernstein, "Mechanisms of Therapeutic Activity for Gallium" Pharmacol. Rev. 50(4) 665-682 (1998).
Abdul-Tehrani et al., "Ferritin Mutants of Escherichia coli Are Iron Deficient and Growth Impaired, and fur Mutants are Iron Deficient" J. Bacteriol. 181(5): 1415-1428 (1999).
Adonai et al., "Ex vivo cell labeling with 64Cu-pyruvaldehyde-bis(N4-methylthiosemicarbazone) for imaging cell trafficking in mice with positron-emission tomography," Proc. Natl. Acad. Sci. USA 99: 3030-3035 (2002).
Aguila, "Iron and Transferrin. Research and Therapeutic Applications" Biotecnologia Aplicada 18(1):1-9 (2001).

Åkerman et al., "Nanocrystal targeting in vivo" PNAS 99(20): 12617-12621 (2002).
Akita et al., "Identification of oligopeptides binding to peritoneal tumors of gastric cancer," Cancer Sci. 97(10):1075-1081 (2006).
Altenhoefer et al., "The probiotic *Escherichia coli* strain Nissle 1917 interferes with invasion of human intestinal epithelial cells by different enteroinvasive bacterial pathogens," FEMS Immunol. Med. Microbiol. 40(3): 223-9 (2004).
Amato et al., "Luminous with Promise" Chem. Eng. News. 84(49):69-73 (2006).
Andrews et al., "Bacterial iron homeostasis" FEMS Microbiol. Rev. 27(2-3): 215-237 (2003).
Andrews et al., "Overproduction, purification and characterization of the bacterioferritin of *Escherichia coli* and a C-terminally extended variant," Eur. J. Biochem. 213: 329-338 (1993).
Andrews, "Iron Storage in Bacteria" Adv. Microb. Physiol. 40: 281-351 (1998).
Arap et al., "Cancer treatment by targeted drug delivery to tumor vasculature in a mouse model," Science 279: 377-380 (1998).
Arap et al., "Targeting the prostate for destruction through a vascular address," PNAS 99:(3) 1527-1531 (2002).
Arosio et al., "On Ferritin Heterogeneity" J. Biol. Chem. 253(12): 4451-4458 (1978).
Aziz and Munro. "Iron regulates ferritin mRNA translation through a segment of its 5' untranslated region" Proc. Natl. Acad. Sci. USA 84: 8478-8482 (1987).
Backhed, "Host-bacterial mutualism in the human intestine," Science. 307(5717):1915-20 (2005).
Bagg, "Molecular mechanism of regulation of siderophore-mediated iron assimilation," Microbiol Rev. 51(4):509-18 (1987).
Baichoo and Helmann, J., "Recognition of DNA by Fur: a reinterpretation of the Fur box consensus sequence," Bacteriol. 184(21):5826-32 (2002).
Balchoo et al., "Global analysis of the *Bacillus subtilis* Fur regulon and the iron starvation stimulon" Mol. Microbiol. 45(6):1613-1629 (2002).
Balkwill, F., "Chemokine biology in cancer", Seminars in Immunol., 15: 49-55 (2003).
Barzu, et al., "Induction of a local anti-IpaC antibody response in mice by use of a *Shigella flexneri* 2a vaccine candidate: implications for use of IpaC as a protein carrier," Infect. Immun. 64: 1190-1196 (1996).
Bereswill et al., "Structural, functional and mutational analysis of the pfr gene encoding a ferritin from *Helicobacter pylori*" Microbiology. 144 ( Pt 9): 2505-2516 (1998).
Bereswill et al., "Regulation of Ferritin-Mediated Cytoplasmic Iron Storage by the Ferric Uptake Regulator Homolog (Fur) of *Helicobacter pylori*" J. Bacteriol. 182(21):5948-5953 (2000).
Bermudes et al., "Live bacteria as anticancer agents and tumor-selective protein delivery vectors," Current Opinion in Drug Discovery & Development 5(2):194-199 (2002).
Bertani et al. "Physical and genetic characterization of the genome of *Magnetospirillum magnetotacticum*, strain MS-1" Gene 264: 257-263 (2001).
Beshara et al., "Kinetic analysis of $^{52}$Fe-labelled iron(III) hydroxide-sucrose complex following blous administration using positron emission tomography," Br. J. Haematol. 104: 288-295 (1999).
Beshara et al., "Pharmacokinetics and red cell utilization of iron(III) hydroxide-sucrose complex in anaemic patients: a study using positron emission tomography," Br. J. Haematol. 104: 296-302 (1999).
Bessette et al. "Rapid isolation of high-affinity protein binding peptides using bacterial display" Prot. Eng., Design & Sel. 17(10): 731-739 (2004).
Bisno et al., "Streptococcal infections of skin and soft tissues," N. Engl. J. Med. 334(4): 240-245 (1996).
Blakemore, "Magnetotactic Bacteria," Annu. Rev. Microbiol. 36: 217-238 (1982).
Blum et al., "Intravenous iron supplementation for the treatment of the anemia of moderate to severe chronic renal failure patients not receiving dialysis," Infection. 23(4):234-236 (1996).
Bou-Abdallah et al., "Iron detoxification properties of *Escherichia coli* bacterioferritin" J. Biol. Chem. 277(40): 37064-37069 (2002).

Boudeau et al., "Inhibitory effect of probiotic *Escherichia coli* strain Nissle 1917 on adhesion to and invasion of intestinal epithelial cells by adherent-invasive *E. coli* strains isolated from patients with Crohn's disease," Aliment Pharmacol Ther. 18(1):45-56 (2003).
Braun and Braun, "Active transport of iron and siderophore antibiotics" Curr. Opin. Microbiol. 5:194-201 (2002).
Braun and Braun, "Iron transport and signaling in *Escherichia coli*," FEBS Lett. 529(1): 78-85 (2002).
Braun V., "Iron uptake by *Escherichia coli*," Biosci 1(8s):1409-1421 (2003).
Bremer et al., "Control of Cyclic Chromosome Replication in *Escherichia coli*" Microbiol. Reviews 55(3):459-475 (1991).
Budzikiewicz et al. "Siderophores of the Pseudomonadaceae sensu stricto (Fluorescent and Non-Fluorescent Pseudomonas spp." Fortschr. Chem. Org. Naturst. 87: 81-237 (2004).
Budzikiewicz, "Siderophores of the human pathogenic fluorescent pseudomonads," Curr Top Med Chem. 1(1):1-6 (2001).
Buss et al., "Iron chelators in cancer chemotherapy" Curr Top Med Chem. 4(15):1623-35 (2004).
Calonder et al., "Kinetic modeling of $^{52}$Fe/$^{52m}$Mn-Citrate at the Blood-Brain Barrier by Positron Emission Tomography," J. Neurochem. 73: 2047-2055 (1999).
Cane et al., "Harnessing the Biosynthetic Code: Combinations, Permutations, and Mutations" Science 282:63-68 (1998).
Carniel, "The Yersinia high-pathogenicity island: an iron-uptake island," Microbes Infect. 3(7):561-9 (2001).
Carrillo and Lipman et al., "The Multiple Sequence Alignment Problem in Biology," SIAM J Applied Math 48:1073-1082 (1988).
Carrondo, "Ferritins, iron uptake and storage from the bacterioferritin viewpoint" EMBO J. 22(9):1959-1968 (2003).
Certified English translation of abstract for Aksac S., "[Antibody formation against Agrobacterium tumefaciens in patients with various cancers]," Turk Hij Tecr Biyol Derg. 34(1-2):48-51 (1974) [Article in Italian ].
Chasteen and Harrison. "Mineralization in Ferritin: An Efficient means of Iron Storage," J. Struct. Biol. 126(3): 182-194 (1999).
Chaston et al., "Potent antitumor activity of novel iron chelators derived from Di-2-Pyridylketone isonicotinoyl hydrazone involves fenton-derived free radical generation," Clin. Canc. Res. 10:7365-7374 (2004).
Cheadle, E.J. and A.M. Jackson, "Bugs as Drugs for Cancer," Immunol., 107: 10-19 (2002).
Chen and Morse. "Neisseria gonorrhoeae bacterioferritin: structural heterogeneity, involvement in iron storage and protection against oxidative stress" Microbiology. 145(Pt 10): 2967-2975 (1999).
Choe et al. "A Possible Relation of the *Helicobacter pylori* pfr Gene to Iron Deficiency Anemia?" *Helicobacter*. 6(1): 55-59 (2001).
Choi and Lee. "Secretory and extracellular production of recombinant proteins using *Escherichia coli*," Appl. Microbiol. Biotechnol. 64:625-635 (2004).
Christensen et al., "Transcription of a novel mouse semaphorin gene, M-semaH, correlates with the metastatic ability of mouse tumor cell lines," Cancer Res. 58(6):1238-44 (1998).
Clairmont, C. et al., "Enhanced antitumor activity from tumor-targeting Salmonella expressing endostatin," American Association for Cancer Research: 91st Annual Meeting of the AACR, Apr. 1-5, 2000, 41:732 Abstract #4653 (2000).
Clarke et al., "Structural biology of bacterial iron uptake systems," Current Topics in Medicinal Chemistry 1: 7-30 (2001).
Cohen et al., "Ferritin as an Endogenous MRI Reporter for Noninvasive Imaging of Gene Expression in C6 Glioma Tumors," Neoplasia 7(2): 109-117 (2005).
Cole AM, Ganz T., "Human antimicrobial peptides: analysis and application," Biotechniques. 29(4):822-6, 828, 830-1 (2000).
Collins, J. and C. Wust, "Suppression of SV40 tumors after immunization with group A *Streptococcus pyogenes* and *Bordetella pertussis*," Cancer Res. 34(5):932-7 (1974).
Compton, J.L. and A.A. Szalay, "Insertion of nonhomologous DNA into the yeast genome mediated by homologous recombination with a cotransforming plasmid," Mol Gen Genet. 188(1):44-50 (1982).
Condeelis, J. and J.E. Segall, "Intravital imaging of cell movement in tumors", Nat. Rev. Cancer, 3:921-930 (2003).

Contag et al., "Visualizing Gene Expression in Living Mammals Using a Bioluminescent Reporter" Photochemistry and Photobiology 66(4):523-531 (1997).

Contag et al., "Photonic detection of bacterial pathogens in living hosts," Mol. Microbiol. 18: 593-603 (1995).

Cornelis and Matthijs., "Diversity of siderophore-mediated iron uptake systems in fluorescent pseudomonads: not only pyoverdines," Environ. Microbiol. 4(12): 787-798 (2002).

Cornelissen CN., "Transferrin-Iron uptake by Gram-Negative Bacteria" Frontiers in Bioscience 8: d836-d847 (2003).

Costa et al., "Adoptive immunotherapy of experimental autoimmune encephalomyelitis via T cell delivery of the IL-12 p40 subunit," Journal of Immunology, 167(4):2379-2387 (2001).

Crichton and Ward., "Iron species in iron homeostasis and toxicity," Analyst. 120(3):693-697 (1995).

Crichton et al., "Iron transport and storage" Eur. J. Biochem. 164:485-506 (1987).

Crosa and Walsh., "Genetics and assembly line enzymology of siderophore biosynthesis in bacteria," Microbiol. Mol. Biol. Rev. 66(2): 223-249 (2002).

Crosa JH., "Genetics and molecular biology of siderophore-mediated iron transport in bacteria," Microbiol. Rev. 53(4): 517-30 (1989).

Crosa, "Signal transduction and transcriptional and post-transcriptional control of iron-regulated genes in bacteria," Microbiol Mol Biol Rev. 61(3):319-36 (1997).

Cross et al., "Patterns of cytokine induction by gram-positive and gram-negative probiotic bacteria," FEMS Immunol. Med. Microbiol. 42:173 (2004).

Crystal, "Transfer of Genes to Humans: Early Lessons and Obstacles to Success" Science 270:404-410 (1995).

Culver KW, Ram Z, Wallbridge S, Ishii H, Oldfield EH, Blaese RM. "In vivo gene transfer with retroviral vector-producer cells for treatment of experimental brain tumors," Science. 256(5063):1550-2 (1992).

de Boer et al., "The tac promoter: a functional hybrid derived from the trp and lac promoters," PNAS 80, 21 (1983).

de Wet et al., "Firefly Luciferase Gene: Structure and Expression in Mammalian Cells," Mol. Cell. Biol. 7: 725-737 (1987).

Devereux et al., "A comprehensive set of sequence analysis programs for the VAX," Nucleic Acids Research 12(1): 387-95 (1984).

Dietrich et al., "Delivery of antigen-encoding plasmid DNA into the cytosol of macrophages by attenuated suicide Listeria monocytogenes," Nat Biotechnol. 16(2):181-5 (1998).

Ding et al., "Zinc-dependent dimers observed in crystals of human endostatin," Proc. Natl. Acad. Sci. USA 95:10443-10448 (1998).

Dobrindt et al., "Analysis of genome plasticity in pathogenic and commensal Escherichia coli isolates by use of DNA arrays" J. Bacteriol. 185(6):1831-1840 (2003).

Drechsel and Jung, "Peptide Siderophores" J. Pept. Sci. 4(3): 147-181 (1998).

Dunn et al., "Cancer immunoediting: from immunosurveillance to tumor escape.," Nat Immunol. 3(11):991-8 (2002).

Escher et al., "Bacterial luciferase αβ fusion protein is fully active as a monomer and highly sensitive in vivo to elevated temperature," Proc Natl Acad Sci U S A. 86(17):6528-32 (1989).

Escolar et al., "Evidence of an Unusually long Operator for the Fur repressor in the Aerobactin Promoter of Escherichia coli" J. Biol. Chem. 275(32):24709-24714 (2000).

Falkner and Moss "Transient dominant selection of recombinant vaccinia viruses," J. Virol. 64:3108-2111 (1990).

Faraldo-Gomez and Sansom, "Acquisition of siderophores in gram-negative bacteria,"Nat. Rev. Mol. Cell. Biol. 4(2): 105-116 (2003).

Farkas-Himsley et al., "The bacterial colicin active against tumor cells in vitro and in vivo is verotoxin 1," Proc Natl Acad Sci U S A. 92(15):6996-7000 (1995).

Fatyol, K and A.A. Szalay, "The p14$^{ARF}$ tumor suppressor protein facilitates nucleolar sequestration of hypoxia-inducible factor-II (HIF-II ) and inhibits HIF-1-mediated transcription,"J Biol Chem. 276(30):28421-28429 (2001).

Ferguson and Deisenhofer, "TonB-dependent receptors-structural perspectives," Biochim. Biophys. Acta. 1565(2): 318-332 (2002).

Fernández-Piñas, F. and C.P. Wolk, "Expresssion of luxCD-E in Anabaena sp. can replace the use of exogenous aldehyde for in vivo localization of transcription by luxAB,"Gene 150:169-174 (1994).

Forbes Lab Website, www.ecs.umass.edu/che/faculty/forbes.html, accessed on Feb. 6, 2006.

Forbes et al., "Sparse Initial Entrapment of Systematically Injected Salmonella typhimurium Leads to Heterogenous Accumulation within Tumors," Cancer Res., 63: 5188-5193 (2003).

Fox et al., Erratum to "Anaerobic bacteria as a delivery system for cancer gene therapy: in vitro activation of 5-fluorocytosine by a genetically engineered clostridia," Gene Therapy, 3(8):741 (1996).

Fox et al., "Anaerobic bacteria as a delivery system for cancer gene therapy: in vitro activation of 5-fluorocytosine by genetically engineered clostridia," Gene Therapy, 3(2):173-178, (1996).

Francis et al., "Monitoring bioluminescent Staphyloccus aureus infections in living mice using a novel luxABCDE construct," Infection and Immunity 68(6): 3594-3600 (2000).

Francisco et al., "Transport and anchoring of beta-lactamase to the external surface of Escherichia coli,"PNAS USA 89: 2713-2717 (1992).

Funovics et al., "MR imaging of the her2/neu and 9.2.27 tumor antigens using immunospecific contrast agents" Magnetic Resonance Imaging 22: 843-850 (2004).

Gafvelin, "Topological rules for membrane protein assembly in eukaryotic cells," J Biol Chem. 272(10):6119-27 (1997).

Gautam et al., "Delivery systems for pulmonary gene therapy," American Journal of Respiratory Medicine, 1(1):35-46, (2002).

Gelfand et al., "Infections in burn patients: a paradigm for cutaneous infection in the patient as risk" Am. J. Med. 76(5A):158-165 (1984).

Genove G, Demarco U, Xu H, Goins WF, Ahrens ET. "A new transgene reporter for in vivo magnetic resonance imaging" Nat Med. 11(4):450-454 (2005).

Georgiou et al., "Display of beta-lactamase on the Escherichia coli surface: outer membrane phenotypes conferred by Lpp'-OmpA'-beta-lactamase fusions," Protein End. 9: 239-247 (1996).

Giacomin, L.T. and A.A. Szalay, "Expression of PAL1 promoter luciferase gene function in Arabidopsis thaliana in response to infection by phytopathogenic bacteria," Plant Sci. 116: 59-72 (1996).

Gill and Guarner, "Probiotics and human health: a clinical perspective," Postgrad Med J. 80(947):516-26 (2004).

Grace et al, "Production of recombinant human apoferritin heteromers" Arch Biochem Biophys. 384(1): 116-122 (2000).

Gray, J.W., "Evidence emerges for early metastasis and parallel evolution of primary and metastatic tumors", Cancer Cell, 4(1): 4-6 (2003).

Green et al., "Inhibition of malignant cell growth by 311, a novel iron chelator of the pyridoxal isonicotinoyl hydrazone class: effect on the R2 subunit of ribonucleotide reductase" Clin. Canc. Res. 7:3574-3579 (2001).

Greer III, L.F. and A.A. Szalay, "Imaging of light emission from the expression of luciferases in living cells and organisms: a review," Luminescence. 17(1):43-74 (2002).

Gribskov et al., "Sigma factors from E. coli, B. subtilis, phage SP01, and phage T4 are homologous proteins," Nucl. Acids Res. 14:6745-6763 (1986).

Grossman et al., "Unification of the ferritin family of proteins" PNAS USA 89: 2419-2423 (1992).

Grozdanov et al., "Analysis of the genome structure of the nonpathogenic probiotic Escherichia coli strain Nissle 1917," J Bacteriol. 186(16): 5432-5441 (2004).

Gruenewald et al., "In vivo production of Artificial Nonribosomal Peptide Products in the Heterologous Host Escherichia coli" Appl. Environ. Microbiol. 70(6):3282-3291 (2004).

Guo et al. "Suppression of cell growth by heavy chain ferritin" Biochem Biophys Res Commun. 242(1): 39-45 (1998).

Gura, T., "Systems for identifying new drugs are often faulty," Science, 278:1041-1042, (1997).

Hale et al., "Characterization of virulence plasmids and plasmid-associated outer membrane proteins in Shigella flexneri, Shigella sonnei, and Escherichia coli," Infect Immun. 40(1): 340-350 (1983).

Hall et al., "In vitro efficacy of transferrin-toxin conjugates against glioblastoma multiforme," J Neurosurg. 76(5):838-44 (1992).

Hall et al., "In vivo efficacy of intrathecal transferrin—*Pseudomonas* exotoxin A immunotoxin against LOX melanoma," Neurosurgery 34(4):649-55; discussion 655-6 (1994).

Hantke et al., "Salmochelins, siderophores of *Salmonella enterica* and uropathogenic *Escherichia coli* strains, are recognized by the outer membrane receptor IroN," Proc Natl Acad Sci U S A. 100(7):3677-82. Epub (2003).

Hatta, "Antitumor Mechanisms of *Eubacterium lentum* and its Components," Asian Pacific Journal of Allergy and Immunology 13: 129-137 (1995).

Henderson, "*Vibrio cholerae* iron transport systems: roles of heme and siderophore iron transport in virulence and identification of a gene associated with multiple iron transport systems," Infect Immun. 62(11):5120-5 (1994).

Hill et al., "SirR, a novel iron-dependent repressor in *Staphylococcus epidermidis*," Infect Immun. 66(9): 4123-4129 (1998).

Hirosue et al. "Characterization of Two Genes Encoding Ferritin-Like Protein in *Actinobacillus actinomycetemcomitans*" Microbiol. Immunol. 45(10): 721-727 (2001).

Hockertz, "Immunomodulating effect of killed, apathogenic *Escherichia coli*, strain Nissle 1917, on the macrophage system," Arzneimittelforschung. 41(10):1108-12 (1991).

Holland, "Translocation of bacterial proteins—an overview", Biochimica et biophysica acta 1694:5-16 (2004).

Hong et al., "The use of bacterial spore formers as probiotics," FEMS Microbiol Rev. 29(4):813-35 Epub (2005).

Howard et al., "Iron gathering by zoopathogenic fungi" FEMS Immunology Med. Microbiol. 40:95-100 (2004).

Hudson et al. "Overproduction, purification and characterization of the *Escherichia coli* ferritin" Eur. J. Biochem. 218: 985-995 (1993).

Ianaro et al., "Expression of TGF-β in attenuated *Salmonella typhimurium*: oral administration leads to the reduction of inflammation, I1-2 and IFN-γ, but enhancement of IL-10, in carrageein-induced oedema in mice," Immunology 84:8-15 (1995).

Ilari et al., "Iron incorporation into *Escherichia coli* Dps gives rise to a Ferritin-like microcrystalline core" J. Biol. Chem. 277(40): 37619-37623 (2002).

Itoh et al., "Formation of an RNA primer for initiation of replication of ColE1 DNA by ribonuclease H" Proc. Natl. Acad. Sci. USA 77(5):2450-2454 (1980).

Jadvar et al., "Molecular Imaging Update: "Personalized" Imaging for Improved Diagnosis and Treatment Decisions" Highlights of Soc. Nuc. Med. 52nd Ann. Meeting (2005). (www.medscape.com/viewarticle/510976 accessed on Jul. 5, 2007).

Jain, R.K. and B.T. Fenton, "Intratumoral Lymphatic Vessels: A Case of Mistaken Identity or Malfunction?", Journal of the National Cancer Institute, 94(6): 417-421 (2002).

Jain, R.K. and N.S. Forbes, "Can engineered bacteria help control cancer?"Proc. Natl. Acad. Sci. USA 98(26): 14748-14750 (2001).

Jongbloed et al., "Two minimal Tat translocases in *Bacillus*" Mol. Microbiol. 54(5):1319-1325 (2004).

Kameyama et al., "Bisucaberin, a new siderophore, sensitizing tumor cells to macrophage-mediated cytolysis," J. Antibiotics 40(12):1664-1670 (1987).

Keech et al., "Spectroscopic Studies of Cobalt(II) Binding to *Escherichia coli* bacterioferritin" 272(1):422-429 (1997).

Kelland et al. "Of mice and men: values and liabilities of the athymic nude mouse model in anticancer drug development" European J. Cancer 40:827-836 (2004).

Kemp et al., "Inhibition of Lymphoma Growth In Vivo by Combined treatment with Hydroxyethyl Starch Deferoxamine Conjugate and IgG Monoclonal Antibodies against the Transferrin Receptor" Cancer Res. 55:3817-3824 (1995).

Kerbel et al., "Human Tumor Xenografts as Predictive Preclinical Models for Anticancer Drug Activity in Humans" Cancer Biology & Therapy 2:4 suppl. 1, S134-S139 (2003).

Kim and Yoo, "Cell surface display of hepatitis B virus surface antigen by using *Pseudomonas syringae* ice nucleation protein," Lett. Appl. Microbiol. 29: 292-297 (1999).

Kim et al., "Bacterial cell surface display of an enzyme library for selective screening of improved cellulase variants," Appl. Environ. Microbiol. 66: 788-793 (2000).

Kimura et al., "Selective localization and growth of *Bifidobacterium bifidum* in mouse tumors following intravenous administration," Cancer Res. 40(6):2061-8 (1980).

Kingsley et al., "Iron supplying systems of *Salmonella* in diagnosis, epidemiology and infection" FEMS Immunol. Med. Microbiol. 11:257-264 (1995).

Kunkle and Schmitt, "Analysis of a DtxR-regulated iron transport and siderophore biosynthesis gene cluster in *Corynebacterium diphtheriae*," J Bacteriol. 187(2):422-33 (2005).

Klebba PE., "Three paradoxes of ferric enterobactin uptake," Frontiers in Bioscience 8: s1422-s1436 (2003).

Köster W. Res. "ABC transporter-mediated uptake of iron, siderophores, heme and vitamin B12," Microbiol. 152(3-4): 291-301 (2001).

Kozak, M., "Structural features in Eukaryotic mRNAs that modulate the Initiation of Translation," J. Biol. Chem. 266:19867-19870 (1991).

Kozak, "Regulation of Translation in Eukaryotic Systems" Annu. Rev. Cell Biol. 8: 197-225 (1992).

Kruis, W., "Review article: antibiotics and probiotics in inflammatory bowel disease," Aliment. Pharmacol. Ther. 20 (Suppl 4): 75-78 (2004).

Kues et al., "Replication of Plasmids in Gram-Negative Bacteria" Microbiol. Reviews 53(4):491-516 (1989).

Laakkonen et al., "A tumor-homing peptide with a targeting specificity related to lymphatic vessels," Nature Medicine 8(7): 751-755 (2002).

Lagenaur and Berger, "An anti-HIV microbicide comes alive," Proc Natl Acad Sci U S A. 102(35):12294-5 Epub (2005).

Lamberton et al., "Construction and characterization of a bioluminscent *Streptococcus pyogenes*," Proceedings of the 12th International Symposium on Bioluminescence and Chemiluminescence Progress & Current Appications, Stanley, P.E. and L.J. Kricka et al (Eds). World Scientific Publishing Co. Pte. Ltd., pp. 85-88 (2002).

Lamberton et al., "Generation and characterization of a bioluminescent *Streptococcus pyogenes*," Proceedings of the 12th International Symposium on Bioluminescence & Chemiluminescence: Apr. 5-9, 2002, Robinson College, University of Cambridge, UK, p. 3.22 (2002).

Larson et al., "Triumph over mischance: a role for nuclear medicine in gene therapy," J Nucl Med. 38(8):1230-3 (1997).

Lee et al. "Prodrug and antedrug: two diametrical approaches in designing safer drugs," Arch. Pharm. Res. 25(2): 111-136 (2002).

Lee et al., "The lux genes of the luminous bacterial symbiont *Photobacterium leiognathi*, of the ponyfish," Eur. J. Biochem. 201: 161-167 (1991).

Lee et al., "Surface expression of a protective recombinant pertussis toxin S1 subunit fragment in *Streptococcus gordonii*," Infect. Immunol. 67: 1511-1516 (1999).

Leenders et al., "Blood to brain iron uptake in one Rhesus monkey using [Fe-52]-citrate and positron emission tomography (PET): influence of haloperidol," J. Neural.Transm.Suppl. 43: 123-132 (1994).

Legocki et al., "Bioluminescence in soybean root nodules: Demonstration of a general approach to assay gene expression in vivo by using bacterial luciferase," Proc. Natl. Acad. Sci 83: 9080-9084 (1986).

Lemmon et al., "Anaerobic bacteria as a gene delivery system that is controlled by the tumor microenvironment," Gene Therapy 4: 791-796 (1997).

Lemmon et al., "Anaerobic bacteria as a gene delivery system to tumors," Proceedings of the 85th Annual Meeting of the American Association for Cancer Research, San Francisco, CA Apr. 10-13, 1994, published in: Proc. Am. Cancer Research Assn 35: 374 (1994).

Lewin et al. "Tat peptide-derivatized magnetic nanoparticles allow in vivo tracking and recovery of progenitor cells" Nature Biotechnology 18: 410-414 (2000).

Lewis et al., "Comparison of Four $^{64}$Cu-Labeled Somatostatin Analogues in Vitro and in a Tumor-Bearing Rat Model: Evaluation of New Derivatives for Positron Emission Tomography Imaging and Targeted Radiotherapy," J. Med. Chem. 42: 1341-1347 (1999).

Li et al., "An engineered and assembled fusion protein of antitumor antibiotic lydamycin and scFV antibody directed against type IV collagenase" Yaoxue Xuebao 35(7) 488-91 (Jul. 2000) [English abstract on last page of article].

Li et al., "*Bifidobacterium adolescentis* as a delivery system of endostatin for cancer gene therapy: Selective Inhibitor of angiogenesis and hypoxic tumor growth," Cancer Gene Therapy 10: 105-111 (2003).

Li et al., "Analysis of the *Bacillus subtilis* S10 ribosomal protein gene cluster identifies two promoters that may be responsible for transcription of the entire 15-kilobase S10-spc-alpha cluster,"J. Bacteriol. 179(22):7046-7054 (1997).

Li, W. and C. Li, "Lack of inhibitory effects of Lactic acid bacteria on 1,2-dimethylhydrazine-induced colon tumor," World J Gastroenterol 9(11):2469-2473 (2003).

Lin DC., "Probiotics as functional foods," Nutr Clin Pract. 18(6):497-506 (2003).

Linsalata, "Effects of probiotic bacteria (VSL#3) on the polyamine biosynthesis and cell proliferation of normal colonic mucosa of rats," In Vivo. 19(6):989-95 (2005).

Liu et al., "Anticancer efficacy of systemically delivered anaerobic bacteria as gene therapy vectors targeting tumor hypoxia/necrosis," Gene Ther. 9(4):291-6 (2002).

Lorenz et al., "Isolation and expression of cDNA encoding *Renilla reniformis* luciferase," PNAS USA 88: 4438-4442 (1991).

Louie, A.Y. et al., "In vivo visualization of gene expression using magnetic resonance imaging", Nature Biotechnology, 18: 321-325 (2000).

Love et al., "Radionuclide imaging of Infection," J Nucl Med Technol. 32(2):47-57; quiz 58-9 (2004).

Ma et al., "Bacterioferritin A modulates catalase A (KatA) activity and resistance to hydrogen peroxide in *Pseudomonas aeruginosa*" J. Bacteriol. 181(12):3730-3742 (1999).

Macintyre, "Probiotics: the benefits of bacterial cultures," Compr Ther. 31(3):181-5 (2005).

Maeda et al., "Tumor vascular permeability and the EPR effect in macromolecular therapeutics: a review", J. Controlled Release, 65: 271-284 (2000).

Martinez et al., "Specific Antibody to *Cryptococcus neoformans* Glucurunoxylomannan Antagonizes Antifungal Drug Action against Cryptococcal Biofilms in Vitro" J. Infect. Diseases 194:261-266 (2006).

Martinez-Govea, "Identification and strain differentiation of *Vibrio cholerae* by using polyclonal antibodies against outer membrane proteins," Clin Diagn Lab Immunol. 8(4):768-71 (2001).

Masse et al., "A small RNA regulates the expression of genes involved in iron metabolism in *Escherichia coli*" Proc. Natl. Acad. Sci. 99(7):4620-4625 (2002).

Massoud et al., "Molecular imaging in living subjects: seeing fundamental biological processes in a new light", Genes & Develop. 17:545-580 (2003).

McDonald, D.M. and P.L. Choyke, "Imaging of angiogenesis: from microscope to clinic", Nature Medicine, 9(6): 713-725 (2003).

McIntosh et al., "A probiotic strain of *L. acidophilus* reduces DMH-induced large intestinal tumors in male Sprague-Dawley rats," Nutr Cancer. 35(2):153-9 (1999).

Meighen, E.A. and R.B. Szittner, "Multiple Repetitive Elements and Organization of the lux Operons of Luminescent Terrestrial Bacteria," J. Bacteriol. 174(16):5371-5381 (1992).

Mejare et al., "Selection of cadmium specific hexapeptides and their expression as OmpA fusion proteins in *Escherichia coli*," Protein Eng. 11(6):489-94 (1998).

Mey et al., "Haem utilization in *Vibrio cholerae* involves multiple TonB-dependent haem receptors" Mol. Microbiol. 42(3):835-849 (2001).

Mills et al., "Genetics and Regulation of Heme Iron Transport in *Shigella dysenteriae* and Detection of an Analogous System in *Escherichia coli* OI57:H7" J. Bacteriol. 177(11):3004-3009 (1995).

Mills et al., "Identification of shuA, the Gene Encoding the Heme Receptor of *Shigella dysenteriae*, and Analysis of Invasion and Intracellular Multiplication of a shuA Mutant" Infection and Immunity 65(12):5358-5363 (1997).

Milton et al., "Flagellin A is essential for the virulence of *Vibrio anguillarum*," J. Bact 178(5):1310-1319 (1996).

Moats, et al., "A 'smart' magnetic resonance imaging agent that reports on specific enzymatic activity," Angew. Chem. Int. Ed. Eng., 36(7):726-728, (1997).

Modady et al., "Virulence factors of septicemic *Escherichia coli* strains" Int. J. Med. Microbiol. 295:455-462 (2005).

Morinaga et al., "Antitumor Activity and its Properties if *Eubacterium lentum*," Jpn. J. Cancer Res. (Gann) 79: 117-124 (1988).

Mountz et al. "Technetium-99m NeoTect imaging in vivo of T cells from hCAR transgenic mice," FASEB J. 16(5):A1211 March Meeting abstract (2002).

Mueller, "Layers of mutualism with commensal bacteria protect us from intestinal inflammation," Gut. 55(2):276-84 (2006).

Mutschler et al. "10. Chemotherapy of Malignant Tumors" in: Drug Actions: Basic Principles and Therapeutic Aspects (medpharm (CRC Press), Suttgart, pp. 595-612 (1995).

Nagy et al., "Expression of Hemin Receptor Molecule ChuA is Influenced by RfaH in Uropathogenic *Escherichia coli* Strain 536" Infection and Immunity 69(3):1924-1928 (2001).

Nair et al., "Dps protects cells against multiple stresses during stationary phase" J. Bacteriol. 186(13):4192-4198 (2004).

NCBI Nucleotide AF188737.

NCBI Nucelotide AJ586887.

NCBI Nucleotide AJ586888.

NCBI Nucleotide AJ586889.

Negre, "The siderophore receptor IroN, but not the high-pathogenicity island or the hemin receptor ChuA, contributes to the bacteremic step of *Escherichia coli* neonatal meningitis," Infect Immun. 72(2):1216-20 (2004).

Neilands JB., "Siderophores: structure and function of microbial iron transport compounds," J. Biol. Chem. 270(45): 26723-26726 (1995).

Neilands JB., "Siderophores of bacteria and fungi," Microbiol. Sci. 1(1): 9-14 (1984).

Neilands, "Siderophores," Arch Biochem Biophys. 302(1):1-3 (1993).

Nibbering et al. "Radiolabelled antimicrobial peptides for imaging of infections: a review," Nucl Med Commun. 19(12):1117-21 (1998).

Ogden et al., "The *Escherichia coli* L-arabanose operon: Binding sites of the regulatory proteins and a mechanism of positive and negative regulation" Proc. Natl. Acad. Sci. USA 77(6):3346-50.

O'Kane et al., "Visualization of Bioluminescence as a Marker of Gene Expression in Rhizobium-Infected Soybean Root Nodules," J. Plant Mol. Biol. 10: 387-399 (1988).

Okeke et al., "Molecular epidemiology of the iron utilization genes of enteroaggregative *Escherichia coli*," J Clin Microbiol. 42(1):36-44 (2004).

Orkin et al., "Report and Recommendations of the Panel to Assess the NIH Investment in Research on Gene Therapy," 1-41 Dec. 7, 1995.

Palmer et al. "Export of complex cofactor-containing proteins by the bacterial Tat pathway" Trends in Microbiol. 13(4): 175-180 (2005).

Pan et al., "Regression of Established B16F10 Melanoma with a Recombinant *Listeria monocytogenes* Vaccine," Cancer Research 59:5264-5269 (1999).

Pardal et al., "Applying the principles of stem-cell biology to cancer," Nature Reviews Cancer, 3: 895-902 (2003).

Parish, C.R., "Cancer immunotherapy: The past, the present and the future", Immunology and Cell Biology, 81: 106-113 (2003).

Park et al., "Arginine deiminase: a potential inhibitor of angiogenesis and tumor growth" Br. J. Cancer 89:907-914 (2003).

Pasqualini and Ruoslahti, "Organ targeting in vivo using phage display peptide libraries," Nature 380: 364-366 (1996).

Pasqualini et al., "Aminopeptidase N is a receptor for tumor-homing peptides and a target for inhibiting angiogenesis," Cancer Res. 60: 722-727 (2000).

Paterson et al., "The biology of Gram-positive sortase enzymes" Trends Microbiol. 12(2):89-95 (2004).

Patzer et al., "The colicin G, H and X determinants encode microcins M and H47, which might utilize the catecholate siderophore receptors FepA, Cir, Fiu and IroN" Microbiol. 149:2557-2570 (2003).

Pawelek, J.M. et al., "Bacteria as tumour-targeting vectors," The Lancet Oncology, 4: 548-556 (2003).

Payne et al., "Detection, Isolation, and Characterization of Siderophores", Methods Eznymol. 235:329-344 (1994).

Pfeifer et al., "Biosynthesis of Complex Polyketides in a Metabolically Engineered Strain of *E. coli*" Science 291 (5509):1790-1792 (2001).

Pfeifer et al., "Biosynthesis of Polyketides in Heterologous Hosts" Microbiol. Mol. Biol. Rev. 65(1):106-118 (2001).

Pfeifer et al., "Biosynthesis of Yersiniabactin, a Complex Polyketide-Nonribosomal Peptide, Using *Escherichia coli* as a Heterologous Host" Appl. Environm. Microbiol. 69(11):6698-6702 (2003).

Pfeifer, A., and I. Verma, "Gene therapy: promises and problems," Annual Review of Genomics and Human Genetics, 2:177-211, (2001).

Pilcher, H., "GM Bug activates cancer drug: Bacteria targets medicine to shrivel mouse tumours," news @ nature.com, Published online: Apr. 22, 2004; http://www.nature.com/news/2004/040419/full/040419-9.html, (accessed on Nov. 18, 2004).

Poole and McKay, "Iron acquisition and its control in *Pseudomonas aeruginosa*: many roads lead to Rome," Front Biosci. 8: d661-686 (2003).

Porkka et al., "A fragment of the HMGN2 protein homes to the nuclei of tumor cells and tumor endothelial cells in vivo," PNAS 99(11): 7444-7449 (2002).

Power, "Regulatory gene control of transcription of the L-arabinose operon in *Escherichia coli*," J Biol Chem. 248(22):7806-10 (1973).

Prasher et al., "Primary structure of the *Aequorea victoris* green-fluorescent protein," Gene 111: 229-233 (1992).

Prasher et al., "Sequence Comparison of Complementary DNAs Encoding Aequorin Isotypes," Biochemistry 26: 1326-1332 (1987).

Pulliainen et al. "Dps/Dpr ferritin-like protein: insights into the mechanism of iron incorporation and evidence for a central role in cellular iron homeostasis in *Streptococcus suis*" Mol. Microbiol. 57(4): 1086-1100 (2005).

Qazi, SNA, Counil E, Morrissey J, Rees CED, Cockayne A, Winzer K, Chan WC, Williams P, Hill PJ., "agr expression precedes escape from the endosome of *Staphylococcus aureus*." Infection and Immunity: 69(11): 7074-7082 (2001).

Quadri LE., "Assembly of aryl-capped siderophores by modular peptide synthetases and polyketide synthases," Mol. Microbiol. 37(1): 1-12 (2000).

Rajotte and Ruoslahti., "Membrane dipeptidase is the receptor for a lung-targeting peptide identified by in vivo phage display," J. Biol. Chem. 274(17): 11593-11598 (1999).

Rao, "Toward a live microbial microbicide for HIV: commensal bacteria secreting an HIV fusion inhibitor peptide," Proc Natl Acad Sci U S A. 102(34):11993-8. Epub (2005).

Ratledge and Dover., "Iron metabolism in pathogenic bacteria," Annu. Rev. Microbiol. 54: 881-941 (2000).

Raymond et al., "Enterobactin: an archetype for microbial iron transport," PNAS USA. 100(7): 3584-3588 (2003).

Reddy et al. "Folate-mediated targeting of therapeutic and imaging agents to cancers," Crit Rev Ther Drug Carrier Syst. 15(6):587-627 (1998).

Rehemtulla, A., et al., "Rapid and quantitative assessment of cancer treatment response using in vivo bioluminescence imaging," Neoplasia, 2(6):491-495, (2000).

Reindel et al., "Expression and regulation pattern of ferritin-like DpsA in the archaeon *Halobacterium salinarum*," Biometals. 18(4):387-397 (2005).

Riedmann et al., "Construction of recombinant S-layer proteins (rSbsA) and their expression in bacterial ghosts—a delivery system for the nontypeable *Haemophilus influenzae* antigen Omp26," FEMS Immunol Med Microbiol. 37(2-3):185-92 (2003).

Rizzo, "An improved cyan fluorescent protein variant useful for FRET," Nat Biotechnol. 22(4):445-9 (2004).

Rocchetta et al., "Validation of a Noninvasive, Real-Time Imaging Technology Using Bioluminescent *Escherichia coli* in the Neutropenic Mouse Thigh Model of Infection," Antimicrobial Agents and Chemotherapy 45(1): 129-137 (2001).

Rohde and Dyer., "Mechanisms of iron acquisition by the human pathogens *Neisseria meningitidis* and *Neisseria gonorrhoeae*," Frontiers in Bioscience 8: d1186-d1218 (2003).

Roosenberg, "Studies and syntheses of siderophores, microbial iron chelators, and analogs as potential drug delivery agents," Curr Med Chem. 7(2):159-97 (2000).

Rothenberg, M.L. et al., "Improving the evaluation of new cancer treatments: challenges and opportunities," Nat. Rev. Cancer, 3: 303-309 (2003).

Rouault and Klausner. "Regulation of iron metabolism in Eukaryotes" Curr. Top. Cell. Reg. 35: 1-19 (1997).

Rouault and Klausner, "The impact of oxidative stress on eukaryotic iron metabolism" EXS. 77: 183-197 (1996).

Rubanyi et al., "The future of human gene therapy" Molecular Aspects of Medicine 22:113-142 (2001).

Saba et al., "Lysogenic Bacteria, Capable of Therapeutic Virus Liberation Subsequent to Tumor Cell Targeting" General Science Journal www.wbabin.net/saba/saba21.htm (2005) (Accessed on Dec. 14, 2005).

Sakamoto et al., "Antitumor Effect of Normal Intestinal Microflora on Ehrlich Ascites Tumor," Jpn. J. Cancer Res. (Gann) 79: 109-116 (1988).

Samuelson et al. "Display of proteins on bacteria" J. Biotechnol. 96: 129-154 (2002).

Sartor RB., "Probiotic therapy of intestinal inflammation and infections," Curr. Opin. Gastroenterol. 21(1): 44-50 (2005).

Schalk et al., "A new mechanism for membrane iron transport in *Pseudomonas aeruginosa*," Biochem. Soc. Trans. 30(4): 702-705 (2002).

Schleif, "Regulation of the L-arabinose operon in *Escherichia coli*," SGM Symposium 61: 155-168 (2002).

Schnetz, Embo J., "Silencing of *Escherichia coli* bgl promoter by flanking sequence elements," 14(11):2545-2550 (1995).

Schultz et al., "Green fluorescent protein for detection of the probiotic microorganism *Escherichia coli* strain Nissle 1917 (EcN) in vivo," J. Microbiol. Methods 61(3): 389-398 (2005).

Schultz et al., "Preventive effects of *Escherichia coli* strain Nissle 1917 on acute and chronic intestinal inflammation in two different murine models of colitis," Clin Diagn Lab Immunol. 11(2):372-8 (2004).

Schwartz and Dayhoff, eds., Atlas of Protein Sequence and Structure, National Biomedical Research Foundation, pp. 353-358 (1979).

Schwarze et al., "In vivo protein transduction: delivery of a biologically active protein into the mouse," Science 285: 1569-1572 (1999).

Smith JL. "The Physiological Role of Ferritin-Like Compounds in Bacteria" Crit. Rev. Microbiol. 30(3): 173-185 (2004).

Sommerville, "*Escherichia coli* msbB Gene as a virulence factor and a therapeutic target," Infection and Immunity. 67(12): 6583-6590 (1999).

Spooner et al., "In suicide gene therapy, the site of subcellular localization of the activating enzyme is more important than the rate at which it activates prodrug," Cancer Gene Ther. 7(10):1348-56 (2000).

Springer et al., "Bacteria in Cancer Therapy" Microbiology Today 56:113-115 (Aug. 2005).

Stehle et al., "Plasma protein (albumin) catabolism by the tumor itself—implications for tumor metabolism and the genesis of cachexia", Critical Reviews in Oncology/Hematology, 26: 77-100 (1997).

Stentebjerg-Olesen, "Type 1 fimbriation and phase switching in a natural *Escherichia coli* fimB null strain, Nissle 1917," J Bacteriol. 181(24):7470-8 (1999).

Stillman et al., "Insights into the Effects on Metal Binding of the Systematic Substitution of Five Key Glutamage Ligands in the Ferritin of *Escherichia coli*" J. Biol. Chem. 278(28):26275-26286 (2003).

Stritzker et al., "Tumor-specific colonization, tissue distribution, and gene induction by probiotic *Escherichia coli* Nissle 1917 in live mice" Int J. Med. Microbiol. 297(3):151-162 (2007).

Sturm et al., "*Escherichia coli* Nissle 1917 distinctively modulates T-cell cycling and expansion via toll-like receptor 2 signaling," Infect Immun. 73(3):1452-65 (2005).

Sudimack et al. "Targeted drug delivery via the folate receptor." Adv Drug Deliv Rev. 41(2):147-62 (2000).

Sui et al., "Cell Cycle-Dependent Antagonistic Interactions between Paclitaxel and gamma-Radiation in Combination Therapy" Clin. Canc. Res. 10:4848-4857 (2004).

Sun et al., "Genomic peculiarity of coding sequences and metabolic potential of probiotic *Escherichia coli* strain Nissle 1917 inferred from raw genome data" J. Biotech. 117:147 (2005).

Suvorov et al., "Physical and genetic chromosomal map of an M type 1 strain of *Streptococcus pyogenes*," J. Bacteriol. 178(18): 5546-5549 (1996).

Suzuki and Lonnerdal. "Characterization of mammalian receptors for lactoferrin" Biochem Cell Biol. 80(1):75-80 (2002).

Suzuki et al., "Management of orbital lymphangioma using intralesional injection of OK-432," Br. J. Opthalmol. 84(6): 614-617 (2000).

Tanaka et al, "Preliminary evaluation of intratumoral injection of a *Streptococcus pyogenes* preparation in patients with malignant brain tumors," Cancer 46(7):1688-94 (1980).

Theuer et al., "A recombinant form of pseudomonas exotoxin directed at the epidermal growth factor receptor that is cytotoxic without requiring proteolytic processing," J.Biol.Chem. 267(24): 16872-16877 (1992).

Theys et al., "Tumor-specific gene delivery using genetically engineered bacteria," Curr Gene Ther 3(3): 207-221 (2003).

Timiryasova et al., "Construction of recombinant vaccinia viruses using PUV-inactivated virus as a helper," BioTechniques 31: 534-540 (2001).

Tjuvajev et al., "Imaging the Expression of Transfected Genes in Vivo," Cancer Res. 55(24): 6126-6132 (1995).

Tjuvajev et al., "*Salmonella*-based tumor-targeted cancer therapy: tumor amplified protein expression therapy (TAPET™) for diagnostic imaging," J. Controlled Release, 74: 313-315 (2001).

Tlaskalova-Hogenova, "Commensal bacteria (normal microflora), mucosal immunity and chronic inflammatory and autoimmune diseases," Ummunol Lett. 93(2-3):97-108 (2004).

Torres et al., "Haem iron-transport system in enterohaemorrhagic *Escherichia coli* OI57:H7" Molecular Microbiol. 23(4):825-833 (1997).

Toso et al, "Phase I study of the intravenous administration of attenuated *Salmonella typhimurium* to patients with metastatic melanoma," J Clin Oncol. 20(1):142-52 (2002).

Tsung, K. et al., "Immnune Response Against Large Tumors Eradicated by Treatment with Cyclophosphamide and IL-12," J. Immunol., 160: 1369-1377 (1998).

Ukena et al., "The host response to the probiotic *Escherichia coli* strain Nissle 1917: specific up-regulation of the proinflammatory chemokine MCP-1," BMC Med. Genetics 6:43 (2005).

Vaughan et al., "Diversity, vitality amd activities of intestinal lactic acid bacteria and bifidobacteria assessed by molecular approaches," FEMS Microbiol Rev. 29(3):477-90 (2005).

Vento, S. and F. Cainelli, "Infections in patients with cancer undergoing chemotherapy: aetiology, prevention, and treatment," Lancet, 4: 595-604 (2003).

Venturi et al. "Gene regulation of siderophore-mediated iron acquisition in *Pseudomonas*: not only the Fur repressor," Mol. Microbiol. 17(4): 603-610 (1995).

Verma et al., "Gene therapy- promises, problems and prospects" Nature 389:239-242 (1997).

Visca, "Iron transport and regulation, cell signalling and genomics: lessons from *Escherichia coli* and *Pseudomonas*" Mol Microbiol. 45(5):1177-90 (2002).

Wade et al., "Gene induction during differentiation of human pulmonary type II cells in vitro," Am J. Respir. Cell. Mol. Biol. 34:727-737 (2006).

Wahl, R., et al., "Improved radioimaging and tumor localization with monoclonal F(ab')$_2$," Journal of Nuclear Medicine, 24:316-325, (1983).

Waidner et al. "Essential role of Ferritin Pfr in *Helicobacter pylori* Iron Metabolism and Gastric Colonization" Infec. Immun. 70(7): 3923-3929 (2002).

Wandersman and Delepelaire. "Bacterial iron sources: From siderophores to hemophores" Ann. Rev. Microbiol. 58: 611-647 (2004).

Wang Y. et al., "A study of protein-protein interactions in living cells using luminescence resonance energy transfer (LRET) from *Renilla luciferase* to *Aequorea* GFP," Mol Gen Genet. 264(5):578-87 (2001).

Watson et al., "Molecular Biology of the Gene," The Benjamin/Cummings Publishing Co., 4:224 (1987).

Wehkamp et al., "NF-kappaB- and AP-1-mediated induction of human beta defensin-2 in intestinal epithelial cells by *Escherichia coli* Nissle 1917: a novel effect of a probiotic bacterium," Infect. Immun. 72:5750 (2004).

Weissleder et al. "Drug targeting in magnetic resonance imaging," Magnetic Resonance Quarterly. 8(1):55-63 (1992).

Weissleder et al., "Molecular imaging," Radiol 219:316-333 (2001).

Weissleder, T. et al., "In vivo magnetic resonance imaging of transgene expression," Nat. Med. 6(3): 351-354 (2000).

Welling et al "Radiochemical and biological characteristics of $^{99m}$Tc-UBI 29-41 for imaging of bacterial infections." Nucl Med Biol. 29(4):413-22 (2002).

Welling et al "Technetium-99m labelled antimicrobial peptides discriminate between bacterial infections and sterile inflammations." Eur J Nucl Med. 27(3):292-301 (2000).

Weng et al., "HO-1 expression in type II pneumocytes after transpulmonary gene delivery" Am. J. Physiol. Lung Cell Mol. Physol 278:L1273-L1279 (2000).

West et al. "Identification of a somatodendritic targeting signal in the cytoplasmic domain of the transferrin receptor." J Neurosci. 17(16):6038-47 (1997).

Westendorf, "Intestinal immunity of *Escherichia coli* Nissle 1917: a safe carrier for therapeutic molecules," 43(3):373-84 (2005).

Winkelmann, "Microbial siderophore-mediated transport," Biochem. Soc. Trans. 30(4): 691-696 (2002).

Wooldridge and Williams, "Iron uptake mechanisms of pathogenic bacteria," FEMS Microbiol. Rev. 12(4): 325-348 (1993).

Wu et al., "High resolution microPET imaging of carcino-embryonic antigen-positive xenografts by using a copper-64-labeled engineered antibody fragment," PNAS USA 97(15): 8495-8500 (2000).

Xu and Lee, "Display of polyhistidine peptides on the *Escherichia coli* cell surface by using outer membrane protein C as an anchoring motif," Appl Environ Microbiol. 65(11):5142-7 (1999).

Yamane et al., "Protein traffic for secretion and related machinery of *Bacillus subtilis*" Biosci. Biotechnol. Biochem. 68(10):2007-2023 (2004).

Yan, "Commensal bacteria in the gut: learning who our friends are," Curr Opin Gastroenterol. 20(6):565-71 (2004).

Yang et al., "Ability of *Pseudomonas pseudomallei* Malleobactin to acquire Transferrin-Bound, Lactoferrin-Bound, and Cell-Derived Iron" Infection and Immunity 61(2):656-662 (1993).

Yang et al., "Effects of growth medium composition, iron sources and atmospheric oxygen concentrations on production of luciferase-bacterial magnetic particle complex by a recombinant *Magnetospirillum magneticum* AMB-1," Enzyme Microb. Technol. 29: 13-19 (2001).

Yongxin et al., "Biomineralization and magnetism of bacterial megnetosomes" Chinese Sci. Bulletin 49(24):2563-2568 (2004).

Yoshida et al., "Growth-inhibitory effect of strptococcal antitumor glycoprotein on human epidermoid carcinoma A431 cells: involvement of dephosphorylation of epidermal growth factor receptor," Cancer Research 61(16): 6151-6157 (2001).

Yu et al., "A *Renilla luciferase-Aequorea* GFP (ruc-gfp) fusion gene construct permits real-time detection of promoter activation by exogenously administered mifepristone in vivo," Mol Genet Genomics. 268(2):169-78 (2002).

Yu et al., "Optical imaging: bacteria, viruses, and mammalian cells encoding light-emitting proteins reveal the locations of primary tumors and metastases in animals," Anal Bioanal Chem. 377(6):964-72 (2003).

Yu Y., "Visualization of molecular and cellular events with green fluorescent proteins in developing embryos: a review," Luminescence. 18(1):1-18 (2003) Erratum in: Luminescence. 18(4):243 (2003).

Zhao et al. "Iron and Hydrogen Peroxide Detoxification Properties of DNA-binding Protein from Starved Cells" J. Biol. Chem. 277(31): 27689-27696 (2002).

Zhao et al., "Spatial-temporal imaging of bacterial infection and antibiotic response in intact animals," Proceeding of the National Academy of Sciences 98(17): 9814-9818 (2001).

Zheng et al., "Tumor amplified protein expression therapy: *Salmonella* as a tumor-selective protein delivery vector," Oncology Research 12(3):127-135 (2000).

Zinn et al. "Noninvasive monitoring of gene transfer using a reporter receptor imaged with a high-affinity peptide radiolabeled with 99mTc or 188Re," J Nucl Med. 41(5):887-95 (2000).

Zinn et al., "Simultaneous evaluation of dual gene transfer to adherent cells by gamma-ray imaging," Nuclear Medicine and Biology 28(2):135-144 (2001).

ATCC Accession No. 59324 (accessed on Jan. 4, 2005) (2 pages).

ATCC Accession No. 59325 (accessed on Jan. 4, 2005) (2 pages).

Baaghil et al., "Core formation in *Escherichia coli* bacterioferritin requires a functional ferroxidase center," Biochemistry 42(47):14047-14056 (2003).

Bach-Gansmo et al., "Abdominal MRI using a negative contrast agent," Br. J. Radiol. 66(785):420-425 (1993).

Balbas, P. and F. Bolivar, "Back to basics: pBR322 and protein expression systems in *E. coli*,", P. Methods Mol. Biol. 267: 77-90 (2004).

Bassi et al., "Expression of single chain antibodies (ScFvs) for c-myc oncoprotein in recombinant *Escherichia coli* membranes by using the ice-nucleation protein of *Pseudomonas syringae*," Biotechnol. Prog. 16(4):557-563 (2000).

Bauminger et al., "Stages in iron storage in the ferritin of *Escherichia coli* (EcFtnA): analysis of Mössbauer spectra reveals a new intermediate," Biochemistry. 38(24):7791-7802 (1999).

Bianco, A., "Targeting c-erbB2 and other receptors of the c-erbB family: rationale and clinical applications," J. Chemother. 16 (Suppl 4):52-54 (2004).

Biffi et al., "Antiproliferative effect of fermented milk on the growth of a human breast cancer cell line," Nutr Cancer. 28(1):93-99 (1997).

Brader et al., "*Escherichia coli* Nissle 1917 facilitates tumor detection by positron emission tomography and optical imaging," Clin. Cancer Res. 14(8):2295-2302 (2008).

Brock et al., "Relative availability of transferrin-bound iron and cell-derived iron to aerobactin-producing and enterochelin-producing strains of *Escherichia coli* and to other microorganisms," Infection and Immunity 59(9):3185-3190 (1991).

Butler et al., "Marine siderophores and microbial iron mobilization," Biometals 18:369-374 (2005).

Camaj et al., "Ligand-mediated protection against phage lysis as a positive selection strategy for the enrichment of epitopes displayed on the surface of *E. coli* cells," Biol. Chem. 382:1669-1677 (2001).

Certified English translation of DE 102 09 958 entitled "The use of *Escherichia coli* as antiphlogistic," published Sep. 25, 2003, Inventor: Hibi et al., (10 pages).

Certified English translation of J. Stritzker and A. Szalay, "*E. coli* Nissle 1917: Vom Kriegsveteran weiterentwickelt zum aktiven Kämpfer gegen Tumoren? *E. coli* Nissle 1917: From War Veteran to Genetically-Directed Tumor Fighter" GenomXpress, 4.07, 12-14, (2007) [article in the German language].

Chiancone et al., "Iron and proteins for iron storage and detoxification," Biometals. 17(3):197-202 (2004).

Dale et al., "Involvement of SirABC in Iron-Siderophore Import in *Staphylococcus aureus*," J. Bacteriol. 186(24):8356-8362 (2004).

Eck et al., "Gene-Based Therapy" Goodman & Gilman's The Pharmacological Basis of Therapeutics, McGraw-Hill, New York, p. 77-101 (1996).

Ellerby et al., "Anti-cancer activity of targeted pro-apoptotic peptides," Nat. Med. 5(9):1032-1038 (1999).

Emens, L. and N. Davidson, "Trastuzumab in breast cancer," Oncology 18(9):1117-1128 (2004).

Fuangthong et al., "Recognition of DNA by Three Ferric Uptake Regulator (Fur) Homologs in *Bacillus subtilis*," J. Bacteriol, 185(21):6348-6357 (2003).

Genco, C. and W. Dixon, "Emerging strategies in microbial haem capture," Mol. Microbiol. 39:1-11 (2001).

Gorecki, A., "Prospects and problems of gene therapy: an update," Expert Opin. Emerging Drugs 6(2):187-198 (2001).

Grabherr and Bayer, "Impact of targeted vector design on Co/EI plasmid replication," Trends Biotechnol. 20(6): 257-260 (2002).

Grove, A. and S. Wilkinson, "Differential DNA binding and protection by dimeric and dodecameric forms of the ferritin homolog Dps from *Deinococcus radiodurans*," J. Mol. Biol. 347(3):495-508 (2005).

Guo et al., "Vaccinia as a vector for gene delivery," Expert Opin Biol Ther 4(6):901-917 (2004).

Izuhara et al., "Cloning and sequencing of an *Escherichia coli* K12 gene which encodes a polypeptide having similarity to the human ferritin H subunit," Mol. & Gen. Genet. 225:510-513 (1991).

Jeong et al., "Cell surface display of salmobin, a thrombin-like enzyme from *Agkistrodon halys* venom on *Escherichia coli* using ice nucleation protein," Enzyme Microb. Technol. 28:155-160 (2001).

Jung, Y. and Y. Lee, "RNases in ColE1 DNA metabolism," Mol. Biol. Rep. 22(2-3):195-200 (1995-1996).

Jung et al., "Expression of carboxymethylcellulase on the surface of *Escherichia coli* using *Pseudomonas syringae* ice nucleation protein," Enzyme Microb Technol. 22(5):348-354 (1998).

Jung et al., "Surface display of *Zymomonas mobilis* levansucrase by using the ice-nucleation protein of *Pseudomonas syringae*," Nat. Biotechnol. 16:576-580 (1998).

Kanda et al., "Production of high-titer Epstein-Barr virus recombinants derived from Akata cells by using a bacterial artificial chromosome system," J. Virol. 78(13):7004-7015 (2004).

Khalil et al., "Mechanism of action of tubulysin, an antimitotic peptide from myxobacteria," Chembiochem. 7(4):678-683 (2006).

Kok et al., "Biodistribution and imaging of FDG in rats with LS174T carcinoma xenografts and focal *Escherichia coli* infection," Cancer Biotherapy & Radiopharmaceuticals 20(3):310-315 (2005).

Langridge, W. and A. Szalay, "Bacterial and coelenterate luciferases as reporter genes in plant cells," Chapter 37 in Methods Mol Biol. 82:385-396 (1998).

Lecointre et al., "*Escherichia coli* molecular phylogeny using the incongruence length difference test," Mol. Biol. Evol. 15(22):1685-1695 (1998).

Lee et al., "Microbial cell-surface display," Trends Biotechnol. 21:45-52 (2003).

Levi et al., "Characterization of human ferritin H chain synthetized in *Escherichia coli*," Gene 51(2-3):269-274 (1987).

Liebregts et al., "Effect of *E. coli* Nissle 1917 on post-inflammatory visceral sensory function in a rat model," Neurogastroenterology and Motility 17(3):410-414 (2005).

Liu et al., "A highly efficient recombineering-based method for generating conditional knockout mutations," Genome Res. 13(3):476-484 (2003).

Lu et al., "Expression of thioredoxin random peptide libraries on the *Escherichia coli* cell surface as functional fusions to flagellin: a system designed for exploring protein-protein interactions," Biotechnology (NY) 13: 366-372 (1995).

Marshall et al., "Combinatorial chemistry of metal-binding ligands," Adv. Supramolecular Chem. 8:174-243 (2002).

Nagai et al., "A variant of yellow fluorescent protein with fast and efficient maturation for cell-biological applications," Nat. Biotechnol. 20(1):87-90 (2002).

Nguyen, A. and P. Daugherty, "Evolutionary optimization of fluorescent proteins for intracellular FRET," Nat Biotechnol. 23(3):355-360 (2005).

Papinutto et al., "Structure of two iron-binding proteins from *Bacillus anthracis*," J. Biol. Chem. 277(17):15093-15098 (2002).

Penfold et al., "Isolation, characterisation and expression of the bacterioferritin gene of *Rhodobacter capsulatus*," FEMS Microbiol Lett. 139(2-3):143-148 (1996).

Rong et al., "Engineering large fragment insertions into the chromosome of *Escherichia coli*," Gene. 336(1):73-80 (2004).

Schwyn, B. and B. Neilands, "Universal chemical assay for the detection and determination of siderophores," Anal. Biochem. 160:47-56 (1987).

Shaner et al., "A guide to choosing fluorescent proteins," Nat Methods. 2(12):905-909 (2005).

Shapiro, J. "Changes in gene order and gene expression," Natl. Cancer Inst. Monogr. 60: 87-110 (1982).

Shimazu et al., "Cell surface display of organophosphorus hydrolase using ice nucleation protein," Biotechnol. Prog. 17:76-80 (2001).

Shine, J. and L. Dalgarno, "Determinant of cistron specificity in bacterial ribosomes," Nature 254(5495):34-38 (1975).

Shkrob et al., "Far-red fluorescent proteins evolved from a blue chromoprotein from Actinia equine," Biochem J. 392(Pt 3):649-654 (2005).

Smith, J., "The Physiological Role of Ferritin-Like Compounds in Bacteria," Crit. Rev. Microbiol. 30(3):173-185 (2004).

Soghomonyan et al., "Positron emission tomography (PET) imaging of tumor-localized *Salmonella* expressing HSV1-TK," Cancer Gene Ther. 12(1):101-108 (2005).

Stritzker, J. and A. Szalay, "*E. coli* Nissle 1917: Vom Kriegsveteran weiterentwickelt zum aktiven Kämpfer gegen Tumoren? *E. coli* Nissle 1917: From War Veteran to Genetically-Directed Tumor Fighter" GenomXpress, 4.07, 12-14. (2007) [article in the German language].

Stritzker et al., "Evaluation of an in vivo gene induction system in infected tumor-bearing mice," Proceedings of the 14th International Symposium on Biuluminescence & Chemiluminescence: Chemistry, Biology and Applications. World Scientific:Singapore: 205-208 (2007).

Vellanoweth, R., *Translation and its regulation*. In: Sonenshein AL, Hoch JA, Losick R (eds.) *Bacillus subtilis* and Other Gram Positive Bacteria; Biochemistry, Physiology and Molecular Genetics. American Society for Microbiology, Washington, DC, pp. 699-711 (1993).

Vieira, J. and J. Messing, "Production of single-stranded plasmid DNA," Methods Enzymol. 153:3-11 (1987).

Wang et al., "Superparamagnetic iron oxide contrast agents: physicochemical characteristics and applications in MR imaging," Eur. Radiol. 11(11):2319-2331 (2001).

Weissleder et al., "Ultrasmall superparamagnetic iron oxide: characterization of a new class of contrast agents for MR imaging," Radiology 175:489-493 (1990).

Wood et al., "Introduction to beetle luciferases and their applications," J. Biolumin. Chemilumin. 4(1):289-301 (1989).

Yu et al., "Visualization of tumors and metastases in live animals with bacteria and vaccinia virus encoding light-emitting proteins," Nat Biotech. 22(3): 313-320 (2004).

Zeth et al., "Iron-oxo clusters biomineralizing on protein surfaces: Structural analysis of *Halobacterium salinarum* DpsA in its low- and high-iron states," Proc. Natl. Acad. Sci. 101(38):13780-13785 (2004).

Zhang et al., "Eradication of solid human tumors in nude mice with an intravenously injected light emitting oncolytic vaccinia virus", Cancer Res. 67(20):10038-10046 (2007).

Kruis, W., "Review article: antibiotics and probiotics in inflammatory bowel disease," Aliment. Pharmacol. Ther. 20(Suppl 4):75-78(2004).

Loessner et al., "Remote control of tumour-targeted *Salmonella enterica* serovar Typhimurium by the use of L-arabinose as inducer of bacterial gene expression in vivo," Cell. Microbiol. 9(6):1529-1537 (2007).

Meighen et al., "Molecular Biology of Bacterial Bioluminescence," Microbiol. Rev. 55(1):123-142 (1991).

* cited by examiner

METHODS AND COMPOSITIONS FOR DETECTION OF MICROORGANISMS AND CELLS AND TREATMENT OF DISEASES AND DISORDERS

RELATED APPLICATIONS

Benefit of priority is claimed under 35 U.S.C. §119(e) to U.S. Provisional Application Ser. No. 60/852,389, to Jochen Stritzker, Phil Hill, Aladar A. Szalay and Yong A. Yu, filed on Oct. 16, 2006, entitled "METHODS AND COMPOSITIONS FOR DETECTION OF MICROORGANISMS AND CELLS AND TREATMENT OF DISEASES AND DISORDERS," and to U.S. Provisional Application Ser. No. 60/830,422, to Jochen Stritzker, Phil Hill, Aladar A. Szalay and Yong A. Yu, filed on Jul. 11, 2006, entitled "METHODS AND COMPOSITIONS FOR DETECTION OF MICROORGANISMS AND CELLS AND TREATMENT OF DISEASES AND DISORDERS." The subject matter of each of these applications is incorporated by reference in its entirety.

This application is related to International Application No. PCT/US2007/0158 to Jochen Stritzker, Phil Hill, Aladar A. Szalay and Yong A. Yu, filed on Jul. 11, 2007, entitled "METHODS AND COMPOSITIONS FOR DETECTION OF MICROORGANISMS AND CELLS AND TREATMENT OF DISEASES AND DISORDERS," which also claims priority to U.S. Provisional Application Ser. No. 60/852,389 and to U.S. Provisional Application Ser. No. 60/830,422.

This application is related to U.S. application Ser. No. 11/238,025, to Aladar A. Szalay; Tatyana Timiryasova; Yong A. Yu; Qian Zhang, filed on Sep. 27, 2005, entitled "MICROORGANISMS FOR THERAPY," which is a continuation of U.S. application Ser. No. 10/872,156, to Aladar A. Szalay; Tatyana Timiryasova; Yong A. Yu; Qian Zhang, filed on Jun. 18, 2004, entitled "MICROORGANISMS FOR THERAPY," which claims the benefit of priority under 35 U.S.C. §119(a) to each of EP 03 013 826.7, filed 18 Jun. 2003, entitled "RECOMBINANT VACCINIA VIRUSES USEFUL AS TUMOR-SPECIFIC DELIVERY VEHICLE FOR CANCER GENE THERAPY AND VACCINATION;" EP 03 018 478.2, filed 14 Aug. 2003, entitled "Method for the production of a polypeptide, RNA or other compound in tumor tissue;" and EP 03 024 283.8, filed 22 Oct. 2003, entitled "USE OF A MICROORGANISM OR CELL TO INDUCE AUTOIMMUNIZATION OF AN ORGANISM AGAINST A TUMOR."

This application also is related to International Application Serial No. PCT/US04/19866, filed on Jun. 18, 2004. This application also is related to U.S. Application filed Jun. 10, 2004 Ser. No. 10/866,606, entitled "LIGHT EMITTING MICROORGANISMS AND CELLS FOR DIAGNOSIS AND THERAPY OF TUMORS," which is a continuation of U.S. application Ser. No. 10/189,918, filed Jul. 3, 2002; U.S. Application filed May 19, 2004 Ser. No. 10/849,664, entitled, "LIGHT EMITTING MICROORGANISMS AND CELLS FOR DIAGNOSIS AND THERAPY OF DISEASES ASSOCIATED WITH WOUNDED OR INFLAMED TISSUE" which is a continuation of U.S. application Ser. No. 10/163, 763, filed Jun. 5, 2003; International PCT Application WO 03/014380, filed Jul. 31, 2002, entitled "Microorganisms and Cells for Diagnosis and Therapy of Tumors;" PCT Application WO 03/104485, filed Jun. 5, 2003, entitled, "LIGHT EMITTING MICROORGANISMS AND CELLS FOR DIAGNOSIS AND THERAPY OF DISEASES ASSOCIATED WITH WOUNDED OR INFLAMED TISSUE;" EP Application No. 01 118 417.3, filed Jul. 31, 2001, entitled "LIGHT-EMITTING MICROORGANISMS AND CELLS FOR TUMOUR DIAGNOSIS/THERAPY;" EP Application No. 01 125 911.6, filed Oct. 30, 2001, entitled "LIGHT EMITTING MICROORGANISMS AND CELLS FOR DIAGNOSIS AND THERAPY OF TUMORS;" EP Application No. 02 0794 632.6, filed Jan. 28, 2004, entitled "MICROORGANISMS AND CELLS FOR DIAGNOSIS AND THERAPY OF TUMORS;" and EP Application No. 02 012 552.2, filed Jun. 5, 2002, entitled "LIGHT EMITTING MICROORGANISMS AND CELLS FOR DIAGNOSIS AND THERAPY OF DISEASES ASSOCIATED WITH WOUNDED OR INFLAMED TISSUE." The subject matter of each of these applications is incorporated by reference in its entirety.

This application also is related to U.S. Provisional Application Ser. No. 60/852,390, to Nanhai Chen; Aladar A. Szalay; Yong A. Yu; and Qian Zhang, entitled "MODIFIED VACCINIA VIRUS STRAINS FOR USE IN DIAGNOSTIC AND THERAPEUTIC METHODS," filed Oct. 16, 2006.

The subject matter of each of these applications, publications and international applications is incorporated by reference in its entirety.

INCORPORATION BY REFERENCE OF A SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Jul. 9, 2007, is identical, 1,253 kilobytes in size, and entitled 4812SEQ.001.txt.

FIELD OF THE INVENTION

Methods of detecting microorganisms and cells in a subject and treating diseases and disorders are provided herein. Methods of detecting or diagnosing sites of cellular proliferation associated with diseases, disorders and conditions, such as neoplasms, tumors, neoplastic diseases, cancers, wounds and inflammation, are also provided. Further provided are microorganisms, cells and compositions, combinations and kits containing the microorganisms or cells for use in the methods and use in the preparation of diagnostic and therapeutic or pharmaceutical compositions. Also provided are methods for enriching a composition with respect to certain microorganisms and cells.

BACKGROUND

Various techniques have been reported for use of microorganisms, such as bacteria and viruses, in transferring substances, e.g., nucleic acids and proteins, to cells and organisms. Various techniques have also been reported for detection of microorganisms in samples and in organisms, including animals. Many such techniques involve incorporation of nucleic acid encoding a foreign protein (e.g., a detectable marker or protein of interest for transfer to a sample) into the microorganism. The amount of foreign protein or detectable signal is related to, and thus can be dependent on, the amount of the microorganism present in the sample, the extent to which the microorganism is able to increase in number, or replicate, in the sample and the degree of expression of the foreign marker. Additionally, for some microorganisms, toxicity of the microorganism in the sample, particularly an animal, can necessitate limiting the amount of the microorganism that is provided to the sample.

Accordingly, there is a need for alternative methods and compositions to provide for enhanced detection of microorganisms in a sample, such as an animal, potentially allowing for rapid growth in the sample, at lower initial concentrations, reduced toxicities and with decreased reliance on foreign protein expression.

SUMMARY

Provided herein are compositions containing a microorganism or cell and a diagnostic moiety. An exemplary microorganism or cell is, for example, the bacterial strain *Escherichia coli* Nissle 1917. In one embodiment, the bacteria contain a DNA sequence encoding a protein or polypeptide produced by the bacteria (e.g., an enzyme involved in siderophore biosynthesis, including production of substrates for siderophore biosynthesis, an enzyme that modifies or processes a siderophore, a receptor, a transporter protein, such as a siderophore uptake protein (e.g., FepA protein, IroN protein, FyuA protein or IutA protein), iron acquisition molecule, iron metabolism molecule, an iron transport protein, or an iron storage molecule, such as a ferritin or ferritin-like molecule) as a diagnostic moiety; the DNA sequence can be endogenous or exogenous to the microorganism. In another embodiment, the bacteria contain a DNA sequence encoding a protein or polypeptide (e.g., an enzyme) that cleaves a precursor siderophore to generate a mature siderophore. In one embodiment, the protein or polypeptide normally produced by the microorganism or cell is also a therapeutic agent. Compositions provided herein can be further formulated with any of the therapeutic agents provided herein. In one embodiment, the microorganism or cell is recombinant. Provided herein is a composition containing a microorganism, such as *Escherichia coli* strain Nissle 1917, and a therapeutic agent.

Provided herein is a composition containing a microorganism or cell (e.g., *E. coli* strain Nissle 1917), where the microorganism or cell contains a DNA sequence encoding a therapeutic agent (or encodes a protein or polypeptide responsible for the production of a therapeutic agent) and the therapeutic agent is, for example, one or more of the following molecules: a ferritin-like molecule, a siderophore (e.g., enterobactin, salmochelin, yersiniabactin or aerobactin), iron acquisition molecule, a receptor, a transporter protein, such as a siderophore uptake protein (e.g., FepA protein, IroN protein, FyuA protein or IutA protein), an iron metabolism molecule, or an iron storage molecule, such as a ferritin or ferritin-like molecule, or a combination thereof. Such therapeutic agents deplete iron from the tumor environment. In one embodiment, the one or more molecule(s) is (are) endogenous to the microorganism, exogenous to the microorganism or cell or a combination thereof. In one embodiment, the composition is formulated with an additional therapeutic, such as any of those described herein or known in the art.

Provided herein are compositions of microorganisms or cells that contain one or more heterologous nucleic acid molecules for the expression one or more gene products useful for therapy or for detection of the microorganisms or cells. Expression of such gene products can be controlled by operative linkage to a promoter. In some examples provided herein the promoter can be an inducible promoter. A non-limiting example of an inducible promoter provided herein for use in the compositions and methods provided is sugar-inducible promoter, such as an arabinose inducible promoter system, e.g. the araBAD system. According to the methods provided herein, induction of an arabinose inducible promoter can be carried out in vitro in cell culture or in vivo in a subject that has been administered the microorganisms or cells that contain the promoter. In vivo induction of an inducible promoter can be performed by administering an inducer, such as arabinose, to induce gene expression from the promoter. Provided herein are methods of inducing a promoter in vivo by administration of an inducer molecule by a method of administration, such as orally, for example, by feeding, or injected, such as by intravenous injection.

Pharmaceutical compositions containing a microorganism or cell provided herein can be formulated with a pharmaceutically acceptable vehicle for use in the methods provided herein. The pharmaceutical compositions can be formulated for any mode of administration, including, but not limited to, systemic administration, such as for intravenous administration. The compositions can contain a delivery vehicle, such as a lipid-based carrier, including liposomes and micelles associated with the bacteria.

Provided herein are methods of detecting and/or treating a site of proliferation or a proliferative condition, such as a tumor, tumor tissue, cancer or metastasis by administering to a subject any of the compositions provided herein. Provided herein uses of the compositions provided herein for the preparation of a diagnostic or therapeutic composition for detecting and/or treating a site of proliferation or a proliferative condition, such as a tumor, tumor tissue, cancer or metastasis. Provided herein are pharmaceutical compositions for detecting and/or treating a site of proliferation or a proliferative condition, such as a tumor, tumor tissue, cancer or metastasis.

Provided herein are uses of microorganisms or cells (e.g. Nissle) in the methods provided herein for detecting and/or treating a site of proliferation or a proliferative condition, such as a tumor, tumor tissue, cancer or metastasis. Also provided are uses of microorganisms or cells (e.g. Nissle) for the formulation of compositions for use in the methods provided herein for detecting and/or treating a site of proliferation or a proliferative condition, such as a tumor, tumor tissue, cancer or metastasis.

Provided herein are methods of detecting a site of proliferation or a proliferative condition, such as a tumor, tumor tissue, cancer or metastasis by administering to a subject compositions, containing microorganism or cells, provided herein, whereby detection of the microorganism or cell in the subject indicates the site of proliferation or a proliferative condition. Provided herein are methods of detecting a site of proliferation or a proliferative condition, in which detection is performed externally to the subject.

Provided herein is a method of detecting a site of proliferation or a proliferative condition, such as a tumor, tumor tissue, cancer or metastasis, which includes administering to a subject a composition the contains a recombinant microorganism or cell, wherein the microorganism or cell contains one or more gene(s) encoding one or more molecule(s). Exemplary cancers to be treated include, but are not limited to, pancreatic cancer, lung cancer, ovarian cancer, breast cancer, cervical cancer, bladder cancer, prostate cancer, glioma cancer, adenocarcinoma, liver cancer, skin cancer or a combination thereof. In one embodiment, the tumor is metastatic. The microorganisms and cells used in the methods provided herein have been attenuated such that they are not lethal to the subject. Further, the microorganisms and cells preferentially accumulate in a tumor in the subject.

Microorganisms or cells for the compositions, methods and uses provided herein can be, for example, bacteria, viruses and eukaryotic cells.

Bacteria employed in the methods provided herein include, but are not limited to, mutual or commensal strains of

*Escherichia coli, Bacteroides, Eubacterium, Streptococcus, Actinomyces, Veillonella, Nesseria, Prevotella, Campylobacter, Fusobacterium, Eikenella, Porphyromonas* and *Priopionibacteria*.

In some examples, the microorganism or cell employed in the methods provided herein can be one that can form a mutual or commensal association with the subject, such as strains of *Escherichia coli, Bacteroides, Eubacterium, Streptococcus, Actinomyces, Veillonella, Nesseria, Prevotella, Campylobacter, Fusobacterium, Eikenella, Porphyromonas* and *Propionibacteria*, or one that is a probiotic strain of *Escherichia coli, Bacillus cereus, Bacillus licheniformis, Bacillus pumilus, Bacillus clausii, Bacillus coagulans, Bacillus polyfermenticus, Brevibacillus laterosporus, Lactococcus, Lactobacillus reuteri, Lactobacillus amylovorus, Lactobacillus crispatus, Lactobacillus gallinarum, Lactobacillus gasseri, Lactobacillus johnsonii, Lactobacillus bifidum, Lactobacillus helveticus, Bifidobacterium lactis, Bifidobacterium breve, Leuconostoc mesenteroides, Enterococcus faecium, Pediococcus, Sporolactobacillus inulinus, Saccharomyces*. In other examples, the bacteria employed in the methods provided herein are selected from nonpathogenic or attenuated *E. coli* strains of the O6 serotype, bacteria with five or more systems for acquiring iron.

In a particular example, the bacterium employed in the methods provided herein is *E. coli* Nissle 1917. Derivatives of *E. coli* strain Nissle 1917 can be employed, such as, for example, Nissle strains that either do not produce lipopolysaccharide (LPS), or that produce LPS that lacks the myristic acid moiety of lipid A, strain that do not produce lipid acyl A transferase, strains that lack one or more cryptic plasmids, such as pMut1 and/or pMut2, strains that have reduced L-arabinose metabolism or strains in which the consensus nucleotide sequence for the Fur protein-binding region of the promoter of one or more genes that is negatively regulated by iron is inactivated.

Viruses employed in the methods provided herein include, but are not limited to, vaccinia virus, baculovirus, sindbis virus, Sendai virus, adenovirus, AAV virus, parvovirus, retrovirus, Epstein-Barr virus, papillomavirus, SV40 virus, cytomegalovirus, Newcastle Disease virus, bovine enterovirus, lymphocytic choriomeningitis virus, lentiviruses, a derivative of the Edmonton-B strain of measles virus, herpes simplex virus type 1, or yellow fever virus. Exemplary viruses include, for example, the Lister strain of vaccinia virus, MVM, H-1, MoMULV, HaMUSV, MuMTV, RSV or GaLV. In one embodiment, the virus is the LIVP strain of vaccinia virus.

Eukaryotic cells employed in the methods provided herein include, but are not limited to, fibrosarcoma cells and stem cells.

Provided herein is a method of diagnosing a site of proliferation or a proliferative condition, such as a tumor, tumor tissue, cancer or metastasis by administering to a subject a composition containing *E. coli* Nissle 1917. *E. coli* Nissle 1917 can encode one or more or the following molecule(s): an enzyme involved in siderophore biosynthesis, including production of substrates for siderophore biosynthesis, an enzyme that modifies or processes a siderophore, a receptor, a transporter protein, a ferritin-like molecule, and a combination thereof. Any of the diagnostic methods provided herein can be combined with any of the therapeutic methods provided herein. Such diagnostic methods provided herein can be used to monitor the efficacy of the therapeutic methods provided herein.

Provided herein is a method of treating a site of proliferation or a proliferative condition, such as a tumor, tumor tissue, cancer or metastasis, by administering to a subject a composition containing a microorganism, wherein the microorganism is *E. coli* Nissle 1917. The microorganism or cell can contain one or more gene(s) encoding one or more molecule(s) chosen from among an enzyme involved in siderophore biosynthesis, including production of substrates for siderophore biosynthesis, an enzyme that modifies or processes a siderophore, a receptor, a transporter protein, a ferritin-like molecule or a combination thereof.

A method of treating a site of proliferation or a proliferative condition, such as a tumor, tumor tissue, cancer or metastasis, provided herein can include administering to a subject a composition that contains a recombinant microorganism or cell, wherein the microorganism or cell contains (a) DNA sequence(s) encoding one or more molecule(s) selected from among an enzyme involved in siderophore biosynthesis, including production of substrates for siderophore biosynthesis, an enzyme that modifies or processes a siderophore, a receptor, a transporter protein, a ferritin-like molecule, and a combination thereof. In one embodiment, the microorganism or cell depletes iron from a tumor cell or a tumor environment, thereby dis-regulating iron hemostasis in the tumor cell or tumor environment. Ferritin-like molecules provided herein can be a ferritin produced by a prokaryotic microorganism, a eukaryotic cell or a virus-infected tumor cell. In a particular embodiment, the ferritin produced by a prokaryotic microorganism and is one or more of a bacterial ferritin, a bacterioferritin, a dodecameric ferritin, a rubrerythrin or a combination thereof. Alternatively, ferritin-like molecules provided herein can be a ferritin produced by a eukaryotic cell and is one or more of an H chain, an L chain or a combination thereof. The one or more ferritin(s) can be endogenous to the microorganism, exogenous to the microorganism or cell or a combination thereof. In yet another embodiment, ferritin-like molecules provided herein can be a ferritin produced by a tumor cell that is infected with a recombinant virus. The one or more ferritin(s) can be one or more of a bacterial ferritin, a bacterioferritin, a dodecameric ferritin, a rubrerythrin, an H chain, an L chain or a combination thereof.

Provided herein are microorganisms and cells containing DNA sequences for the expression of one or more siderophores (e.g., enterobactin, salmochelin, yersiniabactin or aerobactin). Such siderophores can be endogenous to the microorganism, exogenous to the microorganism or cell or a combination thereof. For example, a bacterium that expresses endogenous siderophores is provided herein. The bacterium can be further recombinantly engineered to express one or more exogenous siderophores and/or an enzyme involved in producing the exogenous siderophore. A microorganism or cell (e.g., bacterium, virus or eukaryotic cell) that does not normally express a siderophore can be recombinantly engineered to express one or more exogenous siderophores and/or an enzyme involved in producing the exogenous siderophore.

The one or more siderophore(s) can bind(s) to a receptor, and optionally, can be internalized by the microorganism. In such an embodiment, the microorganism or cell is a prokaryotic microorganism and the siderophore is internalized. In another embodiment, the microorganism is a virus, and the siderophore binds to a receptor on the tumor cell surface in the form of a siderophore-metal complex. In yet another embodiment, the cell is a eukaryotic cell, and the siderophore binds to a receptor on the eukaryotic cell surface in the form of a siderophore-metal complex.

Provided herein are methods for diagnosis and/or therapy of tumors wherein the microorganism or cell administered to the subject expresses a recombinant receptor that binds a ligand. The recombinant receptor can be, for example, an outer membrane protein, such as OmpA or OmpC, expressing a recombinant peptide, such as a streptavidin binding peptide or an S-peptide. One embodiment further includes administering to the subject a composition that contains a ligand that binds to the recombinant peptide. Exemplary ligands are conjugated to a molecule such as a detectable moiety, a therapeutic agent or a combination thereof.

In one embodiment, the method further provides for administering to a subject one or more molecule(s): a siderophore, a metal, a peptide ligand or a combination thereof. Siderophores can bind to a receptor on the injected microorganism or cell or on a tumor cell and, optionally, can be internalized. Molecules provided herein can be conjugated to a detectable moiety, a therapeutic agent or a combination thereof. In some embodiments, the detectable moiety and the therapeutic agent are the same. In one embodiment, where the detectable moiety and the therapeutic agent are different, the one or more molecule(s) can be conjugated to a detectable moiety and a therapeutic agent.

The microorganisms and cells used in the methods herein allow for detection of a tumor, tumor tissue, cancer or metastasis based on a signal, such as a signal that is detectable magnetic resonance imaging (MRI), single-photon emission computed tomography (SPECT), positron emission tomography (PET), scintigraphy, gamma camera, a β$^+$ detector, a γ detector, fluorescence imaging or bioluminescence imaging.

The microorganisms and cells used in the methods herein allow for detection of a tumor, tumor tissue, cancer or metastasis through detection of electromagnetic radiation (e.g., light), such as, for example, by administering a microorganism or cell containing a DNA sequence encoding a detectable protein or a protein capable of inducing a detectable signal, such as a fluorescent protein or a luciferase. In some examples, the microorganism or cell contains a DNA sequence encoding one or more enzymes for the production of a substrate for the luciferase.

In some embodiments, the microorganism or cell further acts as a therapeutic agent by depleting iron from the tumor environment or tumor cell, such as sequestration by siderophores, ferritin-like molecules, a receptor that scavenges iron from host, transport proteins or combination thereof.

Diagnostic methods provided herein can be combined with therapeutic methods provided herein. In one non-limiting example, after a tumor, tumor tissue, cancer or metastasis is detected using any of the imaging methods provided herein, the method further includes treating tumor, tumor tissue, cancer or metastasis, which includes administering to a subject a therapeutic agent.

In the methods and uses provided herein, the animals can be non-human animals or can include humans.

Diagnostic moieties provided herein accumulate in a tumor cell or tumor environment. Diagnostic moieties include any of those described herein or known in the art. In some embodiments, the diagnostic moiety is also a therapeutic moiety. In other embodiments, a therapeutic agent can be administered to the subject. Compositions that can be used in the methods herein can be further formulated with a therapeutic agent.

Diagnostic moieties for the compositions, methods and uses provided herein can be any of those described or known in the art such as, for example, a bioluminescent moiety, a fluorescent moiety, a chemiluminescent moiety, a metal, a radionuclide or a combination thereof. Exemplary bioluminescent moieties include for example, a luciferin such as, but not limited to, click beetle luciferin, firefly luciferin, Cypridina luciferin, bacterial luciferin, derivatives of luciferins or a synthetic luciferin analog thereof. Exemplary fluorescent moieties include, for example, a green fluorescent protein (GFP), yellow fluorescent protein (YFP), orange fluorescent protein (OFP), cyan fluorescent protein (CFP), blue fluorescent protein (BFP), red fluorescent protein (RFP), far-red fluorescent protein, or near-infrared fluorescent protein. Exemplary chemiluminescent moieties include, for example, luminol, isoluminol, dioxetanes, acridinium esters, thioesters and sulfonamides, and phenanthridinium esters. Exemplary metals include, for example, iron, gadolinium, gold or gallium, which act as contrast agents in the methods and uses provided herein. Metals can, optionally, be labeled, such as with a radionuclide (e.g., $^{11}$Carbon, $^{11}$Fluorine, $^{13}$Carbon, $^{13}$Nitrogen, $^{15}$Nitrogen, $^{15}$Oxygen, $^{18}$Fluorine, $^{19}$Fluorine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttrium, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium, $^{186}$Rhenium, $^{188}$Rhenium, $^{192}$Iridium, $^{198}$Gold, $^{201}$Thallium, $^{211}$Astatine, $^{212}$Bismuth or $^{213}$Bismuth).

Diagnostic moieties also include those that are produced by a microorganism, such as a bacterium or eukaryotic cell. Diagnostic moieties include, for example, a ferritin-like molecule, a siderophore, a receptor, a transporter protein, an enzyme involved in siderophore biosynthesis, including production of substrates for siderophore biosynthesis, an enzyme that modifies or processes a siderophore, and a combination thereof. Methods of recombinantly engineering a bacterium, a virus or a eukaryotic cell to carry a gene encoding such a type of diagnostic moiety are provided herein. Exemplary receptors include, for example, a recombinant outer membrane protein with an embedded peptide (e.g., a streptavidin binding peptide or an S-peptide) which, optionally, can be conjugated to a detectable label. Likewise, the ferritin-like molecules or siderophores can, optionally, be conjugated to a detectable moiety. In certain embodiments, the detectable moiety and the therapeutic agent are the same molecule. In some examples, the siderophore is conjugated to a metal, such as iron, gallium, gadolinium, manganese, cobalt, zinc, chromium, gold and indium or a radionuclide.

Therapeutic agents for the compositions, methods and uses provided herein can be, for example, an anti-cancer agent. Anti-cancer agents provided herein include, but are not limited to, cytokines, growth factors, photosensitizing agents, radionuclides, toxins, anti-metabolites, signaling modulators, anti-cancer antibiotics, anti-cancer antibodies, angiogenesis inhibitors, radiation therapy, chemotherapeutic compounds, or a combination thereof. Exemplary therapeutic agents are provided herein. In some examples, therapeutic agents can be expressed by the microorganism or cell for use in the therapeutic methods provided herein. Such agents include, but are not limited to, a cytokine, a chemokine, an immunomodulatory molecule, a single chain antibody, antisense RNA, prodrug converting enzyme, siRNA, angiogenesis inhibitor, a toxin, an antitumor oligopeptides, an antimitotic oligopeptide, an anti-cancer polypeptide antibiotic or tissue factor.

Provided herein are microorganisms and cells for use in Gene-Directed Enzyme Prodrug Therapy (GDEPT), in which microorganisms and cells are engineered to secrete an enzyme, or to express a cell-surface attached enzyme, that converts a non-toxic prodrug into a cytotoxic drug. Following administration of the engineered bacteria, eukaryotic cells and/or viruses, the microorganisms and cells are allowed to proliferate and produce the prodrug converting enzyme at the site of the tumor. After a period of time the prodrug is delivered intravenously, or by alternative delivery method, and the prodrug is converted to the cytotoxic form at the site of the tumor, causing toxicity in the surrounding tumor cells. Exemplary prodrug converting enzymes with their prodrug partners are provided herein.

Provided herein are combinations of a siderophore, such as enterobactin, salmochelin, yersiniabactin or aerobactin, and a microorganism that does not produce a siderophore. Provided herein are combinations of a siderophore and a microorganism that expresses a siderophore uptake protein, such as FepA protein, IroN protein, FyuA protein or IutA protein. Provided herein are combinations of a metal and a microorganism that heterologously overproduces a metal-binding molecule or an iron storage, iron metabolism or iron transport molecule. Provided herein are combinations of a sugar, such as arabinose, and a microorganism that contains a heterologous nucleic acid that is operatively-linked to promoter inducible in the presence of the sugar. Also provided herein are combinations of a Nissle bacterium and an anti-tumor or anti-cancer agent. Provided herein are kits containing any of the combinations provided herein.

DETAILED DESCRIPTION

Outline
A. Definitions
B. Methods and Compositions for Detection and Therapy
C. Microorganisms and cells selected or designed for a enhanced capacity to bind, transport, metabolize, store and/or accumulate a metal
   1. Metal binding, acquisition, transport, metabolism, storage and regulation
      a. Iron storage
         i. Prokaryotic ferritins
            (a) Bacterial ferritin
            (b) Bacterioferritin
            (c) Dodecameric ferritin
            (d) Rubrerythrins
         ii. Eukaryotic ferritins
         iii. Viruses
      b. Iron acquisition and transport
         i. Siderophores
            (a) Gram negative bacteria
                (1) Peptide siderophores
                    a. Oligopeptide-containing siderophores
                    b. Siderophores with side-chain-connected amino acids along the backbone
                    c. Siderophores with amino acids acting as functional carriers for chelating groups
                    d. Siderophores containing cyclized amino acids
                    e. Siderophores containing amino acids of unusual structure
              (2) Non-proteinaceous siderophores
              (3) Receptor and Transport proteins
            (b) Gram-positive bacteria
              (1) Siderophores
              (2) Receptor and transport proteins
            (c) Viruses
            (d) Eukaryotic cells
            (e) Multiple siderophore and uptake systems
            (f) Acquisition of metals other than iron
         ii. Other
            (a) Prokaryotic cells
                (1) Acquisition of exogenous siderophores
                (2) Acquisition from host carriers
            (b) Eukaryotic cells
            (c) Viruses
      c. Iron regulation
         i. Prokaryotic cells
            (a) Gram-negative bacteria
            (b) Gram-positive bacteria
         ii. Eukaryotic cells
   2. Ligand binding
      a. Therapeutic agents
      b. Detectable moieties
      c. Targeting of peptides
      d. Targeting of nanostructures
         i. Nanoparticle-peptide/protein conjugates
         ii. Nanoparticles-antibodies conjugates
         iii. Nanoparticle-protein conjugates
      e. Siderophores
D. Methods of modifying microorganisms and cells
   1. Recombinant DNA Technology
      a. Endogenous Gene Expression
      b. Exogenous Gene Expression
         i. Outer membrane proteins (Omp)
         ii. Lpp'OmpA
         iii. Lipoproteins
         iv. Ice-nucleation protein (Inp)
         v. Detectable gene product
         vi. More than one gene product
      c. Inactivation of bacterial genes
      d. Insertion of genes
      e. Screening for above characteristics
E. Microorganism and cell characteristics and species
   1. General characteristics
      a. Attenuated
         i. Reduced toxicity
         ii. Accumulate in immunoprivileged cells and tissues, such as tumor, not substantially in other organs
      b. Replication Competent
   2. Bacteria
      a. Aerobic bacteria
      b. Anaerobic bacteria
   3. Viruses
      a. Cytoplasmic viruses
         i. Poxviruses
            (a) Vaccinia Virus
            (b) Modified Vaccinia Viruses
            (c) The Lister Strain
         ii. Other cytoplasmic viruses
      b. Adenovirus, Herpes, Retroviruses
   4. Eukaryotic cells
F. Imaging
   1. Ferritins
   2. Siderophores
   3. Surface ligands
   4. Detectable gene products
G. Therapy
   1. Selection of bacteria
   2. Administration
      a. Steps prior to administering the microorganism
      b. Mode of administration
      c. Dosage
      d. Number of administrations
   3. Co-administrations
      a. Other therapeutic compounds
      b. Therapeutic gene product expression
   4. State of subject
   5. Monitoring tumor size
   6. Monitoring general health diagnostics
H. Enrichment -continued

DETAILED DESCRIPTION

I. Pharmaceutical compositions, Combinations and Kits
   1. Pharmaceutical compositions
   2. Combinations
   3. Kits
J. Examples

A. DEFINITIONS

Unless defined otherwise, all technical and scientific terms used herein have the same meaning as is commonly understood by one of skill in the art to which the invention(s) belong. All patents, patent applications, published applications and publications, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, the term "microorganism" or "microbe" refers to a virus and to a life form or organism of small size, generally microscopic in size. Thus, for example, the term "microorganism" includes viruses and organisms such as bacteria, archaea, fungi and protists. Microorganisms include eukaryotic and prokaryotic organisms and can be unicellular or multicellular. Although the term "microorganism" as used herein includes unicellular organisms, it does not include a single cell that is not an organism per se but that rather is a cell that occurs in nature as a part of a larger multicellular organism.

As used herein, the term "cell" refers to the basic unit of structure and function of a living organism as is commonly understood in the biological sciences. A cell can be a unicellular organism that is self-sufficient and that can exist as a functional whole independently of other cells. A cell can also be one that, when not isolated from the environment in which it occurs in nature, is part of a multicellular organism made up of more than one type of cell. Such a cell, which can be thought of as a "non-organism" or "non-organismal" cell, generally is specialized in that it performs only a subset of the functions performed by the multicellular organism as whole. Thus, this type of cell is not a unicellular organism. Such a cell can be a prokaryotic or eukaryotic cell, including animal cells such as mammalian cells, human cells and non-human animal cells or non-human mammalian cells. Animal cells include any cell of animal origin that can be found in an animal. Thus, animal cells include, for example, cells that make up the various organs, tissues and systems of an animal.

As used herein, the term "tissue" refers to a group, collection or aggregate of similar cells generally acting to perform a specific function within an organism.

As used herein, the terms immunoprivileged cells and tissues refer to cells and tissues, such as solid tumors and wounded tissues, which are sequestered from the immune system. Generally, administration of a microorganism elicits an immune response that clears the microorganism; immunoprivileged sites, however, are shielded or sequestered from the immune response, permitting the microorganisms or cells to survive and generally to replicate. Immunoprivileged tissues include inflamed tissues, wounded tissues, and proliferating tissues, such as tumor tissues.

As used herein, the term "detect," "detecting" or "detection" with reference to a composition such as, for example, a microorganism, includes any process whereby the presence of the composition is determined. For example, detection of the composition can be direct or indirect. Direct detection involves using a directly detectable feature of the composition itself as a basis for determining its presence. One example of direct detection is detection of light emitted by a composition, such as a microorganism that expresses a fluorescent or luminescent protein. Indirect detection is not based on detecting a directly detectable feature of the composition but rather can involve detection of any detectable feature that is specifically associated with the presence of the composition. For example, indirect detection can involve detection of a detectably labeled ligand that interacts with or binds to the composition (e.g., a microorganism) or can involve detection of a biochemical or physiological effect of the presence of the composition in a subject. Detection can involve any manner of techniques, including use of a signal, such as magnetic resonance imaging, ultrasound signal, X-rays, gamma rays (after annihilation of a positron and an electron in PET scanning), fluorescence or absorption.

As used herein, "modified" with reference to a gene refers to a deleted gene or a gene having one or more truncations, mutations, insertions or deletions. A gene modification can be such that it results in truncation, mutation, an insertion or a deletion of a part or all of a gene product encoded by the gene. A gene modification can be accompanied by a change in function of the gene product and/or a microorganism or cell.

As used herein, to attenuate toxicity of a microorganism or cell means to reduce or eliminate deleterious or toxic effects to a host upon administration of the microorganism or cell compared to an un-attenuated microorganism or cell. As used herein, a microorganism or cell with low toxicity means that upon administration a microorganism or cells does not accumulate in organs and tissues in the host to an extent that results in damage or harm to organs, or that impacts survival of the host to a greater extent than the disease being treated does.

As used herein, accumulation of a microorganism or cell in a targeted tissue refers to the distribution of the microorganism or cell throughout the organism after a time period long enough for the microbes to infect the host's organs or tissues. As one skilled in the art will recognize, the time period for infection of a microbe will vary depending on the microbe, the targeted organ(s) or tissue(s), the immunocompetence of the host, and dosage. Generally, accumulation can be determined at time point from about less than 1 day, about 1 day to about 1 week, about 1 week to about 2, 3 or 4 weeks, about 1 month to about 2, 3, 4, 5, 6 months or longer after infection with the microbes. For purposes herein, the microorganisms or cells preferentially accumulate in the target tissue, such as a tumor, but are cleared from other tissues and organs in the host to the extent that toxicity of the microorganism or cell is mild or tolerable and at most not fatal. As used herein, preferential accumulation refers to accumulation of a microorganism or cell at a first location at a higher level than accumulation at a second location. Thus, a microorganism or cell that preferentially accumulates in immunoprivileged tissue such as tumor relative to normal tissues or organs refers to a microorganism or cell that accumulates in immunoprivileged tissue, such as tumor, at a higher level (concentration) than the microorganism or cell accumulates in normal tissues or organs.

As used herein, a compound produced in a tumor or other immunoprivileged site refers to any compound that is produced in the tumor or tumor environment by virtue of the presence of an introduced microorganism, generally a recombinant microorganism, expressing one or more gene products. For example, a compound produced in a tumor can be, for example, a metabolite, an encoded polypeptide or RNA, or compound that is generated by a recombinant polypeptide (e.g., cell-surface receptor, a siderophore, a ferritin, an enzyme) and the cellular machinery of the tumor or immunoprivileged tissue or cells.

As used herein, bacteria refer to Gram-positive bacteria and Gram-negative bacteria. As used herein, Gram positive (G+) bacteria refer to bacteria that retain the violet stain used in Gram's method. The violet stain is caused by a high amount of peptidoglycan in the cell wall, which typically, but not always lacks the secondary membrane and lipopolysaccharide layer found in Gram-negative bacteria. As used herein, Gram negative (G-) bacteria refer to bacteria that do not retain the violet stain used in Gram's method. On most Gram-stain preparations, Gram-negative organisms will appear red or pink because they are counterstained. In contrast to most Gram-positive bacteria, Gram-negative bacteria have only a few layers of peptidoglycan, lipopolysaccharide and a secondary cell membrane. The space between the layers of peptidoglycan and the secondary cell membrane is called the periplasmic space. Pathogenicity of Gram negative bacteria is usually associated with certain components of their cell walls, including the lipopolysaccharide (endotoxin) layer.

As used herein, "commensal" when used in reference to an association between two organisms, is a particular association in which one member of the association benefits from the association while the other member is essentially unaffected. In a commensal association of organisms, none of the members of the association is significantly harmed by the presence of the other member. Two organisms can form a commensal association under particular, but not necessarily all, conditions. In such cases, as long as an organism is capable of forming a commensal association with the other organism under at least one set of conditions, the organism is considered to be one that can form a commensal association with the other organism.

As used herein, "mutual" when used in reference to an association between two or more organisms, is a particular association which is advantageous to both members of the association. In a mutual association of organisms, none of the members of the association is significantly harmed by the presence of the other member. Two organisms can form a mutual association under particular, but not necessarily all, conditions. In such cases, as long as an organism is capable of forming a mutual association with the other organism under at least one set of conditions, the organism is considered to be one that can form a mutual association with the other organism.

As used herein, a probiotic microorganism refers to a microorganism that confers a benefit to a host in which it can occur. The benefit can be, for example, an overall health benefit to the host, such as preventing, maintaining remission of, preventing recurrence of, reversing or reducing the symptoms or detrimental effects of a disorder or disease of the host. Such disorders/diseases include, but are not limited to, infectious diseases, inflammation, diarrhea (e.g., antibiotic-induced diarrhea, infectious diarrhea and traveler's diarrhea), inflammatory bowel disease, Crohn's disease, pouchitis and colitis. The benefit conferred by a probiotic microorganism can be stabilization of the host microbiota or microecology, for example, by improving the microbial balance of the indigenous microflora (Kruis W. *Aliment. Pharmacol. Ther.* 20 (Suppl 4): 75-78 (2004)). Probiotic microorganisms can exert their effects in a number of ways. For example, a probiotic microorganism can participate in bacterial (e.g., pathogenic bacteria) interference that can occur through the production of antimicrobial substances by the probiotic microorganism and interference of the probiotic microorganism with bacterial attachment/penetration to/into host cells. A probiotic microorganism also can stimulate a host to produce antimicrobial molecules, alter a host's immune response, stimulate mucosal barrier function or alter immunoregulation; such as by decreasing pro-inflammatory molecules and promoting protective molecules (Sartor R B. *Curr. Opin. Gastroenterol.* 21(1): 44-50 (2005)). Exemplary probiotic microorganisms include, but are not limited to, *E. coli* strain Nissle 1917 (O6:K5:H1; Mutaflor; Ardeypharm GmbH, Germany; Schultz et al. *J. Microbiol. Methods* 61(3): 389-398 (2005)). *E. coli* strain Nissle 1917 lacks defined virulence factors such as alpha-hemolysin, other toxins, and mannose-resistant hemagglutinating adhesins (Blum et al. *Infection.* 23(4):234-236 (1996)), P-fimbrial adhesins, and the semirough lipopolysaccharide phenotype and expresses fitness factors such as microcins, ferritins, six different iron uptake systems, adhesins, and proteases, which support its survival and successful colonization of the human gut (Grozdanov et al. *J Bacteriol.* 186(16): 5432-5441 (2004)). *E. coli* Nissle 1917 interferes with bacterial invasion of other bacteria cells via a secreted component (Altenhoefer et al. *FEMS Immunol. Med. Microbiol.* 40(3): 223-9 (2004)). *E. coli* Nissle 1917 can have plasmids (Mutaflor O6:K5:H1, DSM 6601 by Medipharm, Kågeröd, Sweden) or no plasmids (i.e. can be cured of plasmids).

Magnetic bacteria can be isolated from fresh and marine sediments and can produce magnetic particles ($Fe_3O_4$) which can be used for tumor detection or enrichment of bacterial species. An exemplary magnetic bacterium is *Magnetospirillum magneticum* AMB-1 (Yang et al., *Enzyme Microb. Technol.* 29: 13-19 (2001); Blakemore, *Annu. Rev. Microbiol.* 36: 217-238 (1982)).

As used herein, a delivery vehicle for administration refers to a lipid-based or other polymer-based composition, such as liposome, micelle or reverse micelle that associates with an agent, such as a microorganism provided herein, for delivery into a host animal.

As used herein, the term "viral vector" is used according to its art-recognized meaning. It refers to a nucleic acid vector construct that includes at least one element of viral origin and can be packaged into a viral vector particle. The viral vector particles can be used for the purpose of transferring DNA, RNA or other nucleic acids into cells either in vitro or in vivo. Viral vectors include, but are not limited to, retroviral vectors, vaccinia vectors, lentiviral vectors, herpes virus vectors (e.g., HSV), baculoviral vectors, cytomegalovirus (CMV) vectors, papillomavirus vectors, simian virus (SV40) vectors, semliki forest virus vectors, phage vectors, adenoviral vectors, and adeno-associated viral (AAV) vectors.

As used herein, oncolytic viruses refer to viruses that replicate and lyse tumor cells. Oncolytic viruses generally are designed or selected to selectively replicate in tumor cells.

As used herein, angiogenesis is encompasses the totality of processes directly or indirectly involved in the establishment and maintenance of new vasculature (neovascularization), including, but not limited to, neovascularization associated with tumors and neovascularization associated with wounds.

As used herein, "disease or disorder" refers to a pathological condition in an organism resulting from, for example, infection or genetic defect, and characterized by identifiable symptoms.

As used herein, neoplasia refers to the process of abnormal growth, for example, of a cell, tissue or organ. The growth is abnormal in that it is an uncontrolled, generally unrestrained and progressive multiplication of cells typically under conditions that would not normally induce growth and/or that normally would prevent growth. Such abnormal growth can result in the generation of an abnormal mass, referred to as a neoplasm or tumor, which can be benign or malignant. Unlike hyperplasia, neoplastic proliferation persists even in the absence of the original stimulus.

As used herein, neoplastic disease refers to any disease or disorder associated with neoplasia, whether benign or malignant. Examples of such diseases or disorders include, but are not limited to, malignant neoplastic diseases or disorders involving cancer, including tumor development, growth, metastasis and progression. For example, hematological malignancies affecting blood, bone marrow and/or lymph nodes, including leukemia, lymphoma and multiple myeloma, are types of neoplastic diseases or disorders.

As used herein, malignant, as it applies to tumors, refers to primary tumors that have the capacity to invade surrounding tissues and metastasize with loss of growth control and positional control. In contrast, benign tumors do not invade surrounding tissues or metastasize to other areas of an organism.

As used herein, metastasis refers to a growth of abnormal or neoplastic cells distant from the site primarily involved by the morbid process. For example, in the metastatic process, malignant cells can spread from the site of the primary tumor in which they arose and move into lymphatic and blood vessels which transport the cells to normal tissues elsewhere in an organism where the cells continue to proliferate.

As used herein, cancer is a general term for diseases caused by or characterized by any type of malignant tumor. Exemplary cancers include, but are not limited to carcinoma, sarcoma, mesothelioma, and, in particular, pancreatic cancer, lung cancer, ovarian cancer, breast cancer, cervical cancer, bladder cancer, prostate cancer, colorectal cancer, glioma tumors, adenocarcinomas, liver cancer and skin cancer.

As used herein, the term "proliferative condition" refers to any abnormal condition that includes proliferation and/or recruitment of cells. While the condition is abnormal, the cellular proliferation that occurs in the condition can be considered normal or abnormal. For example, the cellular proliferation can be a transient increase in cell numbers such as might occur in typically normal physiological processes including, but not limited to, wound healing and immune responses, for example as occurs in the inflammatory response. The cellular proliferation can be abnormal, such as occurs in neoplasia (both benign and malignant), excessive, misdirected and/or inappropriate immune responses and hyperplasia. An area in which such a proliferative condition occurs is referred to herein as a proliferative site or site of proliferation.

As used herein, hyperplasia refers to an increase in the number of cells of an organ or tissue and generally is associated with an increase in size of the organ or tissue. Examples of hyperplasia include, but are not limited to, polycystic ovary syndrome, congenital adrenal hyperplasia, benign prostatic hyperplasia and hyperplasia of the breast (e.g., benign ductal or lobular hyperplasia).

As used herein, inflammation refers to a condition normally arising due to an immune response to a stimulus, such as, an external or internal insult, for example, an infection (e.g., fungal, parasitic, bacterial or viral), foreign substance or irritation. Inflammation can be local or systemic within an organism and is often characterized by swelling, pain, redness as well as organ dysfunction. Inflammation involves the movement of fluid and cells (e.g., white blood cells or leukocytes, neutrophils, monocytes and T- and B-cells) into the affected area, site or tissue. In some instances, the immune system can trigger an inflammatory response in the absence of a typical insult. Such excessive, misdirected and/or inappropriate immune inflammatory responses can lead to damage of normal, healthy body tissues and are associated with certain diseases and disorders, including, for example, autoimmune diseases and disorders. There are a number of diseases and disorders that can involve inflammation, both neoplastic and non-neoplastic or non-malignant (benign) diseases. Examples of such diseases and disorders include, but are not limited to, arteritis, arthritis, psoriasis, fibroproliferative disorders, restinosis, stenosis, neurodegenerative diseases, sepsis, appendicitis, myocarditis, nephritis, colitis, gastritis, atherosclerosis or arteriosclerosis, inflammatory bowel disease, systemic lupus erythematosis, multiple sclerosis, type 1 diabetes, Crohn's disease, and coronary artery disease.

As used herein, the term "wound" refers to a physical trauma to an organism that can damage cells, tissues, organs and systems of the organism. Wounds include open wounds, such as incisions, burns, lacerations, abrasions, puncture wounds and penetration wounds, which are exposed to the environment, and closed wounds, which are typically internal to the organism and include, for example, contusions, hematomas and crushing injuries.

As used herein, an anti-cancer agent or compound (used interchangeably with "anti-tumor or anti-neoplastic agent") refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with neoplastic disease, tumors and cancer, and can be used in methods, combinations and compositions provided herein. Exemplary anti-neoplastic agents include, but are not limited to, the microorganisms and cells provided herein used singly or in combination and/or in combination with other agents, such as alkylating agents, anti-metabolite, certain natural products, platinum coordination complexes (e.g., cisplatin, carboplatin, and oxaliplatinum), anthracenediones, substituted ureas, methylhydrazine derivatives, adrenocortical suppressants, certain hormones, antagonists and anti-cancer polysaccharides.

As used herein, a method for treating or preventing neoplastic disease means that any of the symptoms, such as the tumor, metastasis thereof, the vascularization of the tumors or other parameters by which the disease is characterized are reduced, ameliorated, prevented, placed in a state of remission, or maintained in a state of remission. It also means that the hallmarks of neoplastic disease and metastasis can be eliminated, reduced or prevented by the treatment. Non-limiting examples of the hallmarks include uncontrolled degradation of the basement membrane and proximal extracellular matrix, migration, division, and organization of the endothelial cells into new functioning capillaries, and the persistence of such functioning capillaries.

As used herein, therapeutic agents are agents that ameliorate the symptoms of a disease or disorder or ameliorate the disease or disorder. Therapeutic agent, therapeutic compound, therapeutic regimen, or chemotherapeutic include conventional drugs and drug therapies, including vaccines, which are known to those skilled in the art and described elsewhere herein. Therapeutic agents include, but are not limited to, moieties that inhibit cell growth or promote cell death, that can be activated to inhibit cell growth or promote cell death, or that activate another agent to inhibit cell growth or promote cell death. Optionally, the therapeutic agent can exhibit or manifest additional properties, such as, properties that permit its use as an imaging agent, as described elsewhere herein. Exemplary therapeutic agents include, for example, cytokines, growth factors, photosensitizing agents, radionuclides, toxins, anti-metabolites, signaling modulators, anti-cancer antibiotics, anti-cancer antibodies, angiogenesis inhibitors, radiation therapy, chemotherapeutic compounds or a combination thereof.

As used herein, a prodrug is a compound that, upon in vivo administration, is metabolized or otherwise converted to the biologically, pharmaceutically or therapeutically active form of the compound. To produce a prodrug, the pharmaceutically active compound is modified such that the active compound is regenerated by metabolic processes. The prodrug can be designed to alter the metabolic stability or the transport characteristics of a drug, to mask side effects or toxicity, to improve the flavor of a drug or to alter other characteristics or properties of a drug. By virtue of knowledge of pharmacodynamic processes and drug metabolism in vivo, those of skill in this art, once a pharmaceutically active compound is known, can design prodrugs of the compound (see, e.g., Nogrady (1985) Medicinal Chemistry A Biochemical Approach, Oxford University Press, New York, pages 388-392). Prodrugs include, but are not limited to, 5-fluorouracil, gancyclovir, and other as described elsewhere herein.

As used herein, a compound conjugated to a moiety refers to a complex that includes a compound bound to a moiety, where the binding between the compound and the moiety can arise from one or more covalent bonds or non-covalent interactions such as hydrogen bonds, or electrostatic interactions. A conjugate also can include a linker that connects the compound to the moiety. Exemplary compounds include, but are not limited to, nanoparticles and siderophores. Exemplary moieties, include, but are not limited to, detectable moieties and therapeutic agents.

As used herein, nanoparticle refers to a microscopic particle whose size is measured in nanometers. Often such particles in nanoscale are used in biomedical applications acting as drug carriers or imaging agents. Nanoparticles can be conjugated to other agents, including, but not limited to detectable/diagnostic agents or therapeutic agents.

As used herein, a detectable label or detectable moiety or diagnostic moiety (also imaging label, imaging agent, or imaging moiety) refers to an atom, molecule or composition, wherein the presence of the atom, molecule or composition can be directly or indirectly measured. As used herein, a detectable moiety or an imaging moiety refer to moieties used to image a microorganism or cell in any of the methods provided herein. Imaging (detectable) moieties include, for example, chemiluminescent moieties, bioluminescent moieties, fluorescent moieties, radionuclides and metals. Such a label can be detected, for example, by visual inspection, by fluorescence spectroscopy, by reflectance measurement, by flow cytometry, by X-rays, by a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. Direct detection of a detectable label refers to, for example, measurement of a physical phenomenon, such as energy or particle emission or absorption of the moiety itself, such as by X-ray or MRI. Indirect detection refers to measurement of a physical phenomenon, such as energy or particle emission or absorption, of an atom, molecule or composition that binds directly or indirectly to the detectable moiety. In a non-limiting example of indirect detection, a detectable label can be biotin, which can be detected by binding to avidin. Non-labeled avidin can be administered systemically to block non-specific binding, followed by systemic administration of labeled avidin. Thus, included within the scope of a detectable label or detectable moiety is a bindable label or bindable moiety, which refers to an atom, molecule or composition, wherein the presence of the atom, molecule or composition can be detected as a result of the label or moiety binding to another atom, molecule or composition. Exemplary diagnostic agents include, for example, metals such as colloidal gold, iron, gadolinium, and gallium-67, fluorescent moieties and radionuclides. Exemplary fluorescent moieties and radionuclides are provided elsewhere herein.

As used herein, magnetic resonance imaging (MRI) refers to the use of a nuclear magnetic resonance spectrometer to produce electronic images of specific atoms and molecular structures in solids, especially human cells, tissues and organs. MRI is non-invasive diagnostic technique that uses nuclear magnetic resonance to produce cross-sectional images of organs and other internal body structures. The subject lies inside a large, hollow cylinder containing a strong electromagnet, which causes the nuclei of certain atoms in the body (such as, for example, $^{1}H$, $^{13}C$ and $^{19}F$) to align magnetically. The subject is then subjected to radio waves, which cause the aligned nuclei to flip; when the radio waves are withdrawn the nuclei return to their original positions, emitting radio waves that are then detected by a receiver and translated into a two-dimensional picture by computer. For some MRI procedures, contrast agents such as gadolinium are used to increase the accuracy of the images.

As used herein, an X-ray refers to a relatively high-energy photon, or a stream of such photons, having a wavelength in the approximate range from 0.01 to 10 nanometers. X-rays also refer to photographs taken with x-rays.

As used herein, an in vivo method refers to a method performed within the living body of a subject.

As used herein, a positive result refers to detection of a tumor using the methods provided herein relative to non-tumorous tissues or organs.

As used herein, a negative result refers to absence of detection of a tumor relative to non-tumorous tissues or organs using the methods provided herein. As used herein, absence of detection of a tumor refers to the inability to distinguish a tumor relative to non-tumorous tissues or organs using the methods provided herein.

As used herein, enrichment refers to a selective isolation and/or collection of one type of bacterium from a mixed culture of bacteria. Enrichment can be any level of percentage of increase in one type of bacterium, including but not limited to, about 1%, 2%, 3%, 4%, 5%, 10%, 20%, 30%, 40%, 50%, 60%, 70%, 80%, 90%, 95% or 100% of one type of bacterium compared to a mixed culture of bacteria. Bacterial cultures and plating of serial dilutions on agar, for example, can be used to determine the percentage of enrichment.

As used herein, a subject includes any organism, including an animal, for whom diagnosis, screening, monitoring or treatment is contemplated. Animals include mammals such as primates and domesticated animals. An exemplary primate is human. A patient refers to a subject such as a mammal, primate, human or livestock subject afflicted with a disease condition or for which a disease condition is to be determined or risk of a disease condition is to be determined.

As used herein, treatment means any manner in which the symptoms of a condition, disorder or disease are ameliorated or otherwise beneficially altered. Treatment also encompasses any pharmaceutical use of the microorganisms or cells described and provided herein.

As used herein, amelioration of the symptoms of a particular disorder such as by administration of a particular pharmaceutical composition refers to any lessening, whether permanent or temporary, lasting or transient that can be attributed to or associated with administration of the composition.

As used herein, an effective amount of a microorganism, cell, or compound for treating a particular disease is an amount that is sufficient to ameliorate, or in some manner reduce the symptoms associated with the disease. Such an amount can be administered as a single dosage or can be administered according to a regimen, whereby it is effective. The amount can cure the disease but, typically, is administered in order to ameliorate the symptoms of the disease. Repeated administration can be required to achieve the desired amelioration of symptoms.

As used herein, nucleic acids include DNA, RNA and analogs thereof, including peptide nucleic acids (PNA) and mixtures thereof. Nucleic acids can be single or double-stranded. Gene can encode, for example, DNA, DNA encoding regulatory RNAs, siRNAs, functional RNAs, etc. When referring to probes or primers, which are optionally labeled, such as with a detectable label, such as a fluorescent or radiolabel, single-stranded molecules are provided. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 5, 6, 7, 8, 9, 10 or more, 20 or more, 30 or more, 50 or more, 100 or more nucleic acids long.

As used herein, operative linkage of heterologous nucleic acids to regulatory and effector sequences of nucleotides, such as promoters, enhancers, transcriptional and translational stop sites, and other signal sequences refers to the relationship between such nucleic acid, such as DNA, and such sequences of nucleotides. For example, operative linkage of heterologous DNA to a promoter refers to the physical relationship between the DNA and the promoter such that the transcription of such DNA is initiated from the promoter by an RNA polymerase that specifically recognizes, binds to and transcribes the DNA. Thus, operatively linked or operationally associated refers to the functional relationship of a nucleic acid, such as DNA, with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes, binds to and transcribes the DNA. In order to optimize expression and/or transcription, it can be necessary to remove, add or alter 5' untranslated portions of the clones to eliminate extra, potentially inappropriate alternative translation initiation (i.e., start) codons or other sequences that can interfere with or reduce expression, either at the level of transcription or translation. In addition, consensus ribosome binding sites can be inserted immediately 5' of the start codon and can enhance expression (see, e.g., Kozak *J. Biol. Chem.* 266: 19867-19870 (1991); Shine and Dalgarno *Nature* 254(5495): 34-38 (1975)). The desirability of (or need for) such modification can be empirically determined.

As used herein, a sequence complementary to at least a portion of an RNA, with reference to antisense oligonucleotides, means a sequence of nucleotides having sufficient complementarity to be able to hybridize with the RNA, generally under moderate or high stringency conditions, forming a stable duplex; in the case of double-stranded antisense nucleic acids, a single strand of the duplex DNA (or dsRNA) can thus be tested, or triplex formation can be assayed. The ability to hybridize depends on the degree of complementarily and the length of the antisense nucleic acid. Generally, the longer the hybridizing nucleic acid, the more base mismatches with an encoding RNA it can contain and still form a stable duplex (or triplex, as the case can be). One skilled in the art can ascertain a tolerable degree of mismatch by use of standard procedures to determine the melting point of the hybridized complex.

As used herein, primer refers to an oligonucleotide containing two or more deoxyribonucleotides or ribonucleotides, typically more than three, from which synthesis of a primer extension product can be initiated. Typically a primer contains a free 3' hydroxy moiety. Experimental conditions conducive to synthesis of a gene product include the presence of nucleoside triphosphates and an agent for polymerization and extension, such as DNA polymerase, and a suitable buffer, temperature, and pH.

As used herein, a promoter region or promoter element or regulatory region refers to a segment of DNA or RNA that controls transcription of the DNA or RNA to which it is operatively linked. The promoter region includes specific sequences that are sufficient for RNA polymerase recognition, binding and transcription initiation. This portion of the promoter region is referred to as the promoter. In addition, the promoter region includes sequences that modulate this recognition, binding and transcription initiation activity of RNA polymerase. These sequences can be cis acting or can be responsive to trans acting factors. Promoters, depending upon the nature of the regulation, can be constitutive or regulated. Exemplary promoters contemplated for use in prokaryotes include, but are not limited to, the bacteriophage T7 and T3 promoters, *E. coli* araBAD promoter (GenBank Accession No. K00953, SEQ ID NO: 2), *E. coli* ompA promoter (SEQ ID NO: 4), *E. coli* lac promoter (SEQ ID NO: 61, Schnetz, *Embo J.* 14(11):2545-2550(1995)), *E. coli* trp promoter (SEQ ID NO: 62, de Boer et al., PNAS 80, 21 (1983)), *E. coli* tac promoter (SEQ ID NO: 63, deBoer et al., *PNAS USA* 80(1); 21-5 (1983)), *Bacillus subtilis* rpsJ promoter (GenBank Accession No. U43929, SEQ ID NO: 3), and *Bacillus megaterium* xylA promoter (Genbank Accession No. Z71474, SEQ ID NO: 15).

As used herein, production by recombinant means by using recombinant DNA methods means the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect stable integration of a gene or portion thereof into a chromosome of the genome. Also contemplated are vectors that are artificial chromosomes, such as yeast artificial chromosomes and mammalian artificial chromosomes. Selection and use of such vectors are well known to those of skill in the art. An expression vector includes vectors capable of expressing DNA that is operatively linked with regulatory sequences, such as promoter regions, that are capable of effecting expression of such DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome. Exemplary vectors include, but are not limited to the plasmid vectors ColE1, pBR322, p15A, pEMBLex2, pMAL-p2, pUC18A2 (a pUC18-derived plasmid containing the ftn gene), pUC118, pGS281, pMK4, pUNK1, pAMβ1 and pTA1060.

Methods for modifying vectors (or plasmids) to affect replication and maintenance of the vector in bacteria are well known to one skilled in the art based on the early characterization of the molecule, including its nucleotide sequence, replication and maintenance mechanisms, and determination of its coding regions (Balbas and Bolivar. *Methods Mol. Biol.* 267: 77-90 (2004); Grabherr and Bayer. *Trends Biotechnol.* 20(6): 257-260 (2002); Jung and Lee. *Mol. Biol. Rep.* 22(2-3): 195-200 (1995-996)).

As used herein, production by recombinant means by using recombinant DNA methods means the use of the well known methods of molecular biology for expressing proteins encoded by cloned DNA.

As used herein, an amplifiable signaling nucleic acid refers to a nucleic acid that can be amplified using known amplification methods such as polymerase chain reaction (PCR).

As used herein, genetic therapy or gene therapy involves the transfer of heterologous nucleic acid, such as DNA or RNA, into certain cells, target cells, of a mammal, particularly a human, with a disorder or conditions for which such therapy is sought. As used herein, genetic therapy or gene therapy can involve the transfer of heterologous nucleic acid, such as DNA, into a microorganism or cell (e.g., a virus, a bacterium, or a eukaryotic cell), which microorganism or cell can be transferred to a mammal, particularly a human, with a disorder or conditions for which such therapy is sought. The nucleic acid, such as DNA, is introduced into the selected target cells, such as directly or indirectly, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that is in some manner a therapeutic product, or which mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, a heterologous nucleic acid (or an exogenous nucleic acid) refers to a nucleic acid that is not normally produced in vivo by the microorganism or cell from which it is expressed or that is produced by a microorganism or cell but is at a different locus or expressed differently or that mediates or encodes mediators that alter expression of endogenous nucleic acid, such as DNA, by affecting transcription, translation, or other regulatable biochemical processes. Heterologous nucleic acid is often not endogenous to the cell into which it is introduced, but has been obtained from another cell or prepared synthetically. Heterologous nucleic acid, however, can be endogenous, but is nucleic acid that is expressed from a different locus or altered in its expression or sequence (e.g., a plasmid). Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous). Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes exogenous peptides/proteins (e.g., cell surface receptors, siderophores, ferritins, etc.), nucleic acid that encodes traceable marker proteins (e.g., a protein that confers drug resistance), nucleic acid that encodes therapeutically effective substances (e.g., anti-cancer agents, enzymes and hormones), and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, the terms overproduce or overexpress when used in reference to a substance, molecule, compound or composition made in a cell or microorganism refers to production or expression at a level that is greater than a baseline, normal or usual level of production or expression of the substance, molecule, compound or composition by the cell or microorganism. A baseline, normal or usual level of production or expression includes no production/expression or limited, restricted or regulated production/expression. Such overproduction or overexpression is typically achieved by modification of a microorganism or cell. For example, a microorganism or cell can be modified or supplemented to contain extra or additional components, such as nucleic acids, that are involved in the production or expression of the substance, molecule, compound or composition. A microorganism or cell can be modified such that any existing production/expression systems are altered to increase production/expression, such as, for example, eliminating or reducing repression of the expression of an existing gene or altering the timing of expression of a gene. Such modifications can be achieved, for example, using standard methods of recombinant DNA technologies known to those of skill in the art. Such modification is referred to as heterologous overproduction or overexpression and the microorganism or cell is referred to as one that heterologously overproduces or overexpresses. Modification of a microorganism or cell to obtain overproduction or overexpression can be also be achieved by mutagenesis, for example, by subjecting a microorganism or cell to conditions, such as growth under particular selective or mutagenic conditions followed by identification of a modified microorganism or cell that overproduces or overexpresses.

As used herein, a therapeutically effective product for gene therapy is a product that is encoded by heterologous nucleic acid, typically DNA, or an RNA product such as dsRNA, RNAi, including siRNA, that upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, an agent or compound that modulates the activity of a protein or expression of a gene or nucleic acid either decreases or increases or otherwise alters the activity of the protein or, in some manner, up- or down-regulates or otherwise alters expression of the nucleic acid in a cell.

As used herein, recitation that amino acids of a polypeptide "correspond to" amino acids in a disclosed sequence, such as amino acids set forth in the Sequence listing, refers to amino acids identified upon alignment of the polypeptide with the disclosed sequence to maximize identity or homology (where conserved amino acids are aligned) using a standard alignment algorithm, such as the GAP algorithm. By aligning the sequences of polypeptides, one skilled in the art can identify corresponding residues, using conserved and identical amino acid residues as guides.

As used herein, the terms "homology" and "identity" are used interchangeably, but homology for proteins can include conservative amino acid changes. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology vary). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444(1988) (other programs include the GCG program package (Devereux, J., et al., *Nucleic Acids Research* 12(I): 387 (1984)), BLASTP, BLASTN, FASTA (Altschul, S. F., et al., *J. Molec. Biol.* 215:403 (1990); Guide to Huge Computers, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., Atlas of Protein Sequence and Structure, National Biomedical Research Foundation, pp. 353-358 (1979); (2) a penalty of 3.0 for each gap and an additional 0.10 penalty for each symbol in each gap; and (3) no penalty for end gaps. Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

The term substantially identical or homologous or similar varies with the context as understood by those skilled in the relevant art and generally means at least 60% or 70%, preferably means at least 80%, more preferably at least 90%, and most preferably at least 95%, 96%, 97%, 98%, 99% or greater identity. As used herein, substantially identical to a product means sufficiently similar so that the property of interest is sufficiently unchanged so that the substantially identical product can be used in place of the product.

As used herein, substantially pure means sufficiently homogeneous to appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound can, however, be a mixture of stereoisomers or isomers. In such instances, further purification might increase the specific activity of the compound.

As used herein equivalent, when referring to two sequences of nucleic acids, means that the two sequences in question encode the same sequence of amino acids or equivalent proteins. When equivalent is used in referring to two proteins or peptides or other molecules, it means that the two proteins or peptides have substantially the same amino acid sequence with only amino acid substitutions (such as, but not limited to, conservative changes) or structure and the any changes do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, a receptor refers to a molecule that has an affinity for a ligand. Receptors can be naturally-occurring or synthetic molecules. Receptors also can be referred to in the art as anti-ligands. As used herein, the receptor and anti-ligand are interchangeable. Receptors can be used in their unaltered state or bound to other polypeptides, including as homodimers. Receptors can be attached to, covalently or noncovalently, or in physical contact with, a binding member, either directly or indirectly via a specific binding substance or linker. Examples of receptors, include, but are not limited to: antibodies, cell membrane receptors surface receptors and internalizing receptors, monoclonal antibodies and antisera reactive with specific antigenic determinants (such as on viruses, cells, or other materials), drugs, polynucleotides, nucleic acids, peptides, cofactors, lectins, sugars, polysaccharides, cells, cellular membranes, and organelles.

As used herein, bind, bound and binding refer to the binding between atoms or molecules with a $K_d$ in the range of $10^{-2}$ to $10^{-15}$ mole/L, generally, $10^{-6}$ to $10^{-15}$, $10^{-7}$ to $10^{-15}$ and typically $10^{-8}$ to $10^{-15}$ (and/or a $K_a$ of $10^5$-$10^{12}$, $10^7$-$10^{12}$, $10^8$-$10^{12}$ L/mole). As used herein, luminescence refers to the detectable electromagnetic (EM) radiation, generally, ultraviolet (UV), infrared (IR) or visible EM radiation that is produced when the excited product of an exergic chemical process reverts to its ground state with the emission of light. Chemiluminescence is luminescence that results from a chemical reaction. Bioluminescence is chemiluminescence that results from a chemical reaction using biological molecules (or synthetic versions or analogs thereof) as substrates and/or enzymes. Fluorescence is luminescence in which light of a visible color is emitted from a substance under stimulation or excitation by light or other forms radiation such as ultraviolet (UV), infrared (IR) or visible EM radiation.

As used herein, chemiluminescence refers to a chemical reaction in which energy is specifically channeled to a molecule causing it to become electronically excited and subsequently to release a photon thereby emitting visible light. Temperature does not contribute to this channeled energy. Thus, chemiluminescence involves the direct conversion of chemical energy to light energy.

As used herein, bioluminescence, which is a type of chemiluminescence, refers to the emission of light by biological molecules, particularly proteins. The essential condition for bioluminescence is molecular oxygen, either bound or free in the presence of an oxygenase, a luciferase, which acts on a substrate, a luciferin. Bioluminescence is generated by an enzyme or other protein (luciferase) that is an oxygenase that acts on a substrate luciferin (a bioluminescence substrate) in the presence of molecular oxygen and transforms the substrate to an excited state, which, upon return to a lower energy level releases the energy in the form of light.

As used herein, the substrates and enzymes for producing bioluminescence are generically referred to as luciferin and luciferase, respectively. When reference is made to a particular species thereof, for clarity, each generic term is used with the name of the organism from which it derives such as, for example, click beetle luciferase or firefly luciferase.

As used herein, luciferase refers to oxygenases that catalyze a light emitting reaction. For instance, bacterial luciferases catalyze the oxidation of flavin mononucleotide (FMN) and aliphatic aldehydes, which reaction produces light. Another class of luciferases, found among marine arthropods, catalyzes the oxidation of Cypridina (Vargula) luciferin and another class of luciferases catalyzes the oxidation of Coleoptera luciferin.

Thus, luciferase refers to an enzyme or photoprotein that catalyzes a bioluminescent reaction (a reaction that produces bioluminescence). The luciferases, such as firefly and *Gaussia* and *Renilla* luciferases, are enzymes which act catalytically and are unchanged during the bioluminescence generating reaction. The luciferase photoproteins, such as the aequorin photoprotein to which luciferin is non-covalently bound, are changed, such as by release of the luciferin, during bioluminescence generating reaction. The luciferase is a protein, or a mixture of proteins (e.g., bacterial luciferase), that occurs naturally in an organism or a variant or mutant thereof, such as a variant produced by mutagenesis that has one or more properties, such as thermal stability, that differ from the naturally-occurring protein. Luciferases and modified mutant or variant forms thereof are well known. For purposes herein, reference to luciferase refers to either the photoproteins or luciferases.

Thus, reference, for example, to *Renilla* luciferase refers to an enzyme isolated from member of the genus *Renilla* or an equivalent molecule obtained from any other source, such as from another related copepod, or that has been prepared synthetically. It is intended to encompass *Renilla* luciferases with conservative amino acid substitutions that do not substantially alter activity. Conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224).

As used herein, bioluminescence substrate refers to the compound that is oxidized in the presence of a luciferase and any necessary activators and generates light. These substrates are referred to as luciferins herein, are substrates that undergo oxidation in a bioluminescence reaction. These bioluminescence substrates include any luciferin or analog thereof or any synthetic compound with which a luciferase interacts to generate light. Typical substrates include those that are oxidized in the presence of a luciferase or protein in a light-generating reaction. Bioluminescence substrates, thus, include those compounds that those of skill in the art recognize as luciferins. Luciferins, for example, include firefly luciferin, Cypridina (also known as Vargula) luciferin (coelenterazine), bacterial luciferin, as well as synthetic analogs of these substrates or other compounds that are oxidized in the presence of a luciferase in a reaction the produces bioluminescence.

As used herein, capable of conversion into a bioluminescence substrate refers to being susceptible to chemical reaction, such as oxidation or reduction, that yields a bioluminescence substrate. For example, the luminescence producing reaction of bioluminescent bacteria involves the reduction of a flavin mononucleotide group (FMN) to reduced flavin mononucleotide ($FMNH_2$) by a flavin reductase enzyme. The reduced flavin mononucleotide (substrate) then reacts with oxygen (an activator) and bacterial luciferase to form an intermediate peroxy flavin that undergoes further reaction, in the presence of a long-chain aldehyde, to generate light. With respect to this reaction, the reduced flavin and the long chain aldehyde are substrates.

As used herein, a bioluminescence generating system refers to the set of reagents required to conduct a bioluminescent reaction. Thus, the specific luciferase, luciferin and other substrates, solvents and other reagents that can be required to complete a bioluminescent reaction form a bioluminescence system. Thus a bioluminescence generating system refers to any set of reagents that, under appropriate reaction conditions, yield bioluminescence. Appropriate reaction conditions refers to the conditions necessary for a bioluminescence reaction to occur, such as pH, salt concentrations and temperature. In general, bioluminescence systems include a bioluminescence substrate, luciferin, a luciferase, which includes enzymes luciferases and photoproteins and one or more activators. A specific bioluminescence system can be identified by reference to the specific organism from which the luciferase derives; for example, the *Renilla* bioluminescence system includes a *Renilla* luciferase, such as a luciferase isolated from *Renilla* or produced using recombinant methods or modifications of these luciferases. This system also includes the particular activators necessary to complete the bioluminescence reaction, such as oxygen and a substrate with which the luciferase reacts in the presence of the oxygen to produce light.

As used herein, a fluorescent protein (FP) refers to a protein that possesses the ability to fluoresce (i.e., to absorb energy at one wavelength and emit it at another wavelength). For example, a green fluorescent protein (GFP) refers to a polypeptide that has a peak in the emission spectrum at 510 nm or about 510 nm. A variety of FPs that emit at various wavelengths are known in the art. Exemplary FPs include, but are not limited to, a green fluorescent protein (GFP), yellow fluorescent protein (YFP), orange fluorescent protein (OFP), cyan fluorescent protein (CFP), blue fluorescent protein (BFP), red fluorescent protein (RFP), far-red fluorescent protein, or near-infrared fluorescent protein. Extending the spectrum of available colors of fluorescent proteins to blue, cyan, orange yellow and red variants, provides a method for multicolor tracking of fusion proteins.

As used herein, *Aequorea* GFP refers to GFPs from the genus *Aequorea* and to mutants or variants thereof. Such variants and GFPs from other species, such as *Anthozoa* reef coral, *Anemonia* sea anemone, *Renilla* sea pansy, *Galaxea* coral, *Acropora* brown coral, *Trachyphyllia* and *Pectiniidae* stony coral and other species are well known and are available and known to those of skill in the art. Exemplary GFP variants include, but are not limited to BFP, CFP, YFP and OFP. Examples of fluorescent proteins and their variants include GFP proteins, such as Emerald (InVitrogen, Carlsbad, Calif.), EGFP (Clontech, Palo Alto, Calif.), Azami-Green (MBL International, Woburn, Mass.), Kaede (MBL International, Woburn, Mass.), ZsGreen1 (Clontech, Palo Alto, Calif.) and CopGFP (Evrogen/Axxora, LLC, San Diego, Calif.); CFP proteins, such as Cerulean (Rizzo, *Nat Biotechnol.* 22(4): 445-9 (2004)), mCFP (Wang et al., *PNAS USA.* 101(48): 16745-9 (2004)), AmCyan1 (Clontech, Palo Alto, Calif.), MiCy (MBL International, Woburn, Mass.), and CyPet (Nguyen and Daugherty, *Nat Biotechnol.* 23(3):355-60 (2005)); BFP proteins such as EBFP (Clontech, Palo Alto, Calif.); YFP proteins such as EYFP (Clontech, Palo Alto, Calif.), YPet (Nguyen and Daugherty, *Nat Biotechnol.* 23(3): 355-60 (2005)), Venus (Nagai et al., *Nat. Biotechnol.* 20(1): 87-90 (2002)), ZsYellow (Clontech, Palo Alto, Calif.), and mCitrine (Wang et al., *PNAS USA.* 101(48):16745-9 (2004)); OFP proteins such as cOFP (Strategene, La Jolla, Calif.), mKO (MBL International, Woburn, Mass.), and mOrange; and others (Shaner N C, Steinbach P A, and Tsien R Y., *Nat Methods.* 2(12):905-9 (2005)).

As used herein, red fluorescent protein, or RFP, refers to the Discosoma RFP (DsRed) that has been isolated from the corallimorph Discosoma (Matz et al., *Nature Biotechnology* 17: 969-973 (1999)), and red or far-red fluorescent proteins from any other species, such as *Heteractis* reef coral and *Actinia* or *Entacmaea* sea anemone, as well as variants thereof. RFPs include, for example, Discosoma variants, such as mRFP1, mCherry, tdTomato, mStrawberry, mTangerine (Wang et al., *PNAS USA.* 101(48):16745-9 (2004)), DsRed2 (Clontech, Palo Alto, Calif.), and DsRed-T1 (Bevis and Glick, *Nat. Biotechnol.,* 20: 83-87 (2002)), *Anthomedusa* J-Red (Evrogen) and *Anemonia* AsRed2 (Clontech, Palo Alto, Calif.). Far-red fluorescent proteins include, for example, *Actinia* AQ143 (Shkrob et al., *Biochem J.* 392(Pt 3):649-54 (2005)), *Entacmaea* eqFP611 (Wiedenmann et al. *Proc Natl Acad Sci USA.* 99(18):11646-51 (2002)), Discosoma variants such as mPlum and mRasberry (Wang et al., *PNAS USA.* 101(48): 16745-9 (2004)), and *Heteractis* HcRed1 and t-HcRed (Clontech, Palo Alto, Calif.).

As used herein the term assessing or determining is intended to include quantitative and qualitative determination in the sense of obtaining an absolute value for the activity of a product, and also of obtaining an index, ratio, percentage, visual or other value indicative of the level of the activity. Assessment can be direct or indirect.

As used herein, activity refers to the in vivo activities of a compound or microorganisms and cells on physiological responses that result following in vivo administration thereof (or of a composition or other mixture). Activity, thus, encompasses resulting therapeutic effects and pharmaceutical activity of such compounds, compositions and mixtures. Activities can be observed in in vitro and/or in vivo systems designed to test or use such activities.

As used herein, sample refers to anything that can contain an analyte for which an analyte assay is desired. The sample can be a biological sample, such as a biological fluid or a biological tissue. Examples of biological fluids include urine, blood, plasma, serum, saliva, semen, stool, sputum, cerebral spinal fluid, tears, mucus, amniotic fluid or the like. Biological tissues are aggregates of cells, usually of a particular kind together with their intercellular substance that form one of the structural materials of a human, animal, plant, bacterial, fungal or viral structure, including connective, epithelium, muscle and nerve tissues. Examples of biological tissues also include organs, tumors, lymph nodes, arteries and individual cell(s).

As used herein, an immunoassay is defined as any method using a specific or preferential binding of an antigen with a second material (i.e., a binding partner, usually an antibody, antibody fragment or another substance having an antigen binding site) that specifically or preferentially binds to an epitope of the antigen. The immunoassay methods provided herein include any known to those of skill in the art, including, but not limited to, sandwich, competition, agglutination, or precipitation assays.

As used herein, antibody refers to an immunoglobulin, whether natural or partially or wholly synthetically produced, including any derivative thereof that retains the specific binding ability of the antibody. Hence antibody includes any protein having a binding domain that is homologous or substantially homologous to an immunoglobulin binding domain. Antibodies include members of any immunoglobulin class, including IgG, IgM, IgA, IgD and IgE.

As used herein, antibody fragment refers to any derivative of an antibody that is less then full length, retaining at least a portion of the full-length antibody's specific binding ability. Examples of antibody fragments include, but are not limited to, Fab, Fab', F(ab)2, single-chain Fvs (scFV), FV, dsFV diabody and Fd fragments. The fragment can include multiple chains linked together, such as by disulfide bridges. An antibody fragment generally contains at least about 50 amino acids and typically at least 200 amino acids.

As used herein, an Fv antibody fragment is composed of one variable heavy chain domain (VH) and one variable light chain domain linked by noncovalent interactions.

As used herein, a dsFV refers to an Fv with an engineered intermolecular disulfide bond, which stabilizes the VH-VL pair.

As used herein, a F(ab)$_2$ fragment is an antibody fragment that results from digestion of an immunoglobulin with pepsin at pH 4.0-4.5; it can be recombinantly produced to produce the equivalent fragment.

As used herein, Fab fragments are antibody fragments that result from digestion of an immunoglobulin with papain; it can be recombinantly produced to produce the equivalent fragment.

As used herein, scFVs refer to antibody fragments that contain a variable light chain (VL) and variable heavy chain (VH) covalently connected by a polypeptide linker in any order. The linker is of a length such that the two variable domains are bridged without substantial interference. Included linkers are (Gly-Ser)n residues with some Glu or Lys residues dispersed throughout to increase solubility.

As used herein, humanized antibodies refer to antibodies that are modified to include human sequences of amino acids so that administration to a human does not provoke an immune response. Methods for preparation of such antibodies are known. For example, to produce such antibodies, the encoding nucleic acid in the hybridoma or other prokaryotic or eukaryotic cell, such as an *E. coli* or a CHO cell, that expresses the monoclonal antibody is altered by recombinant nucleic acid techniques to express an antibody in which the amino acid composition of the non-variable region is based on human antibodies. Computer programs have been designed to identify such non-variable regions.

As used herein, diabodies are dimeric scFV; diabodies typically have shorter peptide linkers than scFvs, and they generally dimerize.

As used herein, a molecule, such as an antibody, that specifically binds to a polypeptide typically has a binding affinity (Ka) of at least about $10^6$ l/mol, $10^7$ l/mol, $10^8$ l/mol, $10^9$ l/mol, $10^{10}$ l/mol or greater and binds to a protein of interest generally with at least 2-fold, 5-fold, generally 10-fold or even 100-fold or greater, affinity than to other proteins. In one non-limiting example, an antibody that specifically binds to an epitope in, for example, a streptavidin binding peptide, binds with at least about 2-fold, typically 5-fold, 10-fold higher affinity or 100-fold higher affinity, than it binds to another peptide. Such specific binding also is referred to as selective binding. Thus, specific or selective binding refers to greater binding affinity (generally at least 2-fold, 5-fold, 10-fold or more) to a targeted site or locus compared to a non-targeted site or locus.

As used herein, complex refers generally to an association between two or more species regardless of the nature of the interaction between the species (i.e., ionic, covalent, or electrostatic).

As used herein, a combination refers to any association between two or among more items.

As used herein, a composition refers to any mixture. It can be a solution, a suspension, an emulsion, liquid, powder, a paste, aqueous, non-aqueous or any combination thereof.

As used herein, fluid refers to any composition that can flow. Fluids thus encompass compositions that are in the form of semi-solids, pastes, solutions, aqueous mixtures, gels, lotions, creams and other such compositions.

As used herein, a kit is a packaged combination, optionally, including instructions for use of the combination and/or other reactions and components for such use.

For clarity of disclosure, and not by way of limitation, the detailed description is divided into the subsections that follow.

B. METHODS AND COMPOSITIONS FOR DETECTION AND THERAPY

Provided herein are methods of detecting a location(s) in a subject in which a microorganism or cell administered to the subject accumulates and compositions for use in the methods. Combinations and kits that include such compositions and that can be used in the methods are also provided. The methods can be used, for example, to detect or image sites of cellular proliferation, tumors, tumor tissues, metastases, areas of inflammation, immunoprivileged sites or tissues, wounds and infections. Such methods find applications in, for example, detection and diagnosis of diseases and disorders, evaluating the efficacy of a treatment or therapy for a disease or disorder, developing non-human animal models for diseases and disorders, assaying or screening compositions for potential use as therapeutic agents for the treatment of diseases and disorders and in tracking or monitoring delivery of compositions to cells and tissues, including, sites of cellular proliferation, tumors, tumor tissues, metastases, areas of inflammation, wounds and infections. In one embodiment, the methods for determining the presence or absence of a microorganism or cell, or disease or disorder, involve monitoring a subject or patient to whom a microorganism or cell has been administered for detection of the microorganism or cell. A particular microorganism that is monitored for detection in such methods is one that heterologously overproduces one or more of an iron acquisition, storage, metabolism, binding or transport molecule. Such microorganisms can be monitored for detection using a number of techniques, including, but not limited to techniques capable of detecting a metal, and in particular, iron, in a subject. A particular detection technique that can be used in such methods is magnetic resonance imaging (MRI). In another embodiment, the methods for determining the presence or absence of a microorganism or cell, or disease or disorder, involve monitoring a subject to whom a microorganism or cell and a ligand have been administered for detection of the ligand. In such methods, the microorganism or cell expresses a siderophore uptake protein and the ligand is one that interacts with the siderophore uptake protein. A particular ligand that can be monitored for detection in such methods is a siderophore. The siderophore can be detected in a number of ways, including, for example, through interaction with a detectable moiety, such as a metal, which in some embodiments can be a radionuclide. In another embodiment, the methods for determining the presence or absence of a microorganism or cell, or disease or disorder, involve monitoring a subject to whom a virus has been administered for detection of one or more molecules produced upon expression of one or more peptides or proteins encoded by heterologous nucleic acid of the virus. In a particular embodiment, the peptide is contained with in a fusion protein of a bacterial outer membrane protein, such as OmpA or OmpC, and the peptide within an extracellular domain of the outer membrane protein. In a further particular embodiment of such methods, the molecule(s) produced upon expression of the peptide(s) or protein(s) encoded by the nucleic acid of the virus is one or more of an iron storage, metabolism, binding or transport molecule.

Also provided herein are methods of treating diseases and disorders and compositions for use in such methods. Such diseases and disorders include, for example, proliferative conditions, neoplastic diseases, tumors, tumor tissue, cancer, metastasis, inflammation, wounds and infections. Combinations and kits that include such compositions and that can be used in the treatment methods are further provided. The methods include administering a microorganism or cell to a subject or patient having, at risk of having or suspected of having a disease or disorder, such as a proliferative condition, neoplastic disease, tumor, tumor tissue, cancer, metastasis, inflammation, wounds or infection. In one embodiment of the methods for treating a disease or disorder, the microorganism or cell contains nucleic acid that encodes or provides for the production of a therapeutic composition. In another embodiment, the method includes administration of a microorganism or cell and administration of a metal-binding or metal-chelating molecule or of a metal that is or is complexed with a therapeutic composition. Examples of therapeutic compositions that can be used in such methods include, but are not limited to, compositions that are deleterious to a tumor or cancer cell, antiproliferative agents, anti-inflammatory compositions, antibiotics and compositions that promote wound healing. In another embodiment, the treatment method includes administration of a microorganism or cell that heterologously overproduces one or more of an iron storage, metabolism, binding or transport molecule. In a further embodiment, a microorganism or cell is and a metal-binding or -chelating molecule are administered to the subject together or separately as a combination therapy for treatment of a disease, disorder or condition as described herein.

Microorganisms and cells, as well as compositions, combinations and kits that include the microorganisms or cells, are also provided herein and can be used in the methods provided herein. In particular embodiments, the microorganisms or cells tend to accumulate in a certain area or areas of a subject to whom the microorganisms or cells are administered. Microorganisms and cells used in the methods of detecting and/or treating a site of proliferation of a proliferative condition (e.g., a tumor, tumor tissue, cancer, metastasis, neoplasm, neoplastic disease, site of inflammation, wound, wound tissue and infection) are capable of selectively accumulating in such sites or in immunoprivileged sites relative to other locations in a subject. Accumulation is selective in that the microorganisms and cells tend to accumulate at such sites to at least an equal and typically detectably greater extent than they accumulate at other locations in a subject. The degree of selective accumulation can be demonstrated in a number ways describe herein such as, for example, by evaluating and comparing the extent of accumulation of the microorganisms or cells in different locations in a subject after systemic, e.g., intravenous, administration of the microorganism or cells to a subject having a site of proliferation or proliferative condition as described herein. Accordingly, detection of the microorganisms or cells provides for detection and evaluation of such sites. Furthermore, because such microorganisms and cells selectively accumulate at such sites, they can be used to specifically deliver substances and compositions to the sites, including therapeutic substances and compositions for use in treating diseases, disorders and conditions associated with proliferation sites and conditions, including, for example, tumors, cancers, neoplasms, neoplastic diseases, inflammation, wounds and other diseases, conditions and disorders as described herein. Also provided are embodiments of the treatment methods in which the microorganisms and cells themselves provide a therapeutic benefit in the treatment of diseases, disorders and/or conditions without providing for delivery of a separate therapeutic substance or composition.

A factor in the selective accumulation of the microorganisms and cells may be that they tend to be cleared from most of the body of the subject to whom they are administered by the activity of the subject's immune system, indicative of recognition of the microorganisms and cells by the subject's immune system. However, in the environment of a proliferative site or condition (including, for example, a tumor, tumor tissue, cancer, metastasis, neoplasm, neoplastic disease, site of inflammation, wound, wound tissue and infection) the microorganisms and cells can nevertheless survive, replicate, proliferate and accumulate. Accordingly, for enhanced accumulation, the microorganisms and cells in particular embodiments are replication competent. The selective accumulation of such microorganisms and cells is thus not attributable to a targeting moiety, such as a heterologous protein that binds to a molecule that is fairly unique to the targeted site in the subject, that has been incorporated into the microorganism or cell to direct it to a particular site. Rather, in this case the selective accumulation can be viewed as a result of the conditions of the environment at the site of proliferation or of a proliferative condition. In some embodiments, however, the selective accumulation of the microorganism at a target site can be enhanced through the incorporation of a targeting moiety into the microorganism or cell.

In methods provided herein for detecting the location of a microorganism or cell that has been administered to a subject, the degree of selective accumulation capable by the microorganism or cell is not a consideration. In such methods, the microorganism's or cell's location(s) and distribution in the subject is what is determined, not necessarily the site of a proliferative condition or disease or disorder. Thus, in such methods, any of the detectable microorganisms or cells provided herein can be used.

Microorganisms and cells provided herein include microorganisms and cells that are readily detectable within a cell, tissue or subject and/or that coexist in a commensal or mutualistic relationship with a subject such as, for example, an animal, including human and non-human animals. In particular embodiments, the microorganism is a bacterium, fungus or virus. Readily detectable microorganisms and cells provided and/or used herein include microorganisms and cells that possess features that facilitate specific detection, or have been modified to facilitate specific detection, in a subject. For example, microorganisms and cells, and in particular, bacteria, that contain at least two, three, four, five or six or more iron acquisition systems are provided that are well suited for detection using methods and techniques based on detection of metals (including but not limited to iron) that can be accumulated by such microorganisms and cells. The microorganism or cell can be one that naturally possesses the iron acquisition systems or can be one that has been modified, such as through introduction of heterologous nucleic acids and recombinant expression, to contain more and/or different iron acquisition systems than it naturally possesses. In another example, microorganisms and cells that heterologously overproduce one or more of an iron acquisition, storage, metabolism, binding or transport molecule are provided. Because of the iron-accumulating capacity of such microorganisms and cells, they are also useful in methods of treating diseases and disorders provided herein. For example, administration of such microorganisms and cells to a subject or patient having a disease, disorder or condition, such as a proliferative condition as described herein, provides for specific binding and accumulation of metals, which can have therapeutic effects, or be complexed to a therapeutic composition, in a site or sites that are associated with the disease or disorder in a subject. In a particular example, the diseases, disorder or condition is a proliferative condition, neoplastic disease, tumor, tumor tissue, cancer, metastasis, inflammation, wound or infection. In methods of treating a tumor, tumor tissue, cancer, metastasis, such microorganisms and cells reduce the amount of iron available to tumor and cancer cells, thereby having a deleterious effect on the tumor cells and their growth and growth of tumors. In other embodiments, microorganisms and cells are provided that have been modified to facilitate specific detection in a subject through incorporation of a detectable marker that is or specifically complexes with a readily detectable moiety. In a particular embodiment, the readily detectable microorganism is a bacterium containing nucleic acid encoding a heterologous fusion protein that is expressed on the surface of the bacterium. In another embodiment, the microorganism is a virus containing nucleic acid encoding a heterologous fusion protein that is expressed on the surface of cells and tissues in which the virus specifically accumulates, such as, for example, tumors, tumor tissues, a metastasis, inflamed tissues, wounds or wounded tissues, or sites of infection. The fusion protein in a particular embodiment is a fusion of a bacterial outer membrane protein and a peptide contained within an extracellular domain of the outer membrane protein. The peptide thus expressed on the surface of the microorganism, cells or tissues provides a site for labeling with a detectable moiety that specifically interacts with the peptide to facilitate detection of the microorganisms, cells or tissues. The peptide expressed on the surface of target cells and tissues also provides a site at which a therapeutic composition or substance can be specifically delivered in methods of treating diseases, disorders and conditions provided herein.

Particular microorganisms that can be used in the methods provided herein include, for example, mutual, commensal and/or probiotic strains of *Escherichia coli, Bacteroides, Eubacterium, Streptococcus, Actinomyces, Veillonella, Nesseria, Prevotella, Campylobacter, Fusobacterium, Eikenella, Porphyromonas* and Propionibacteria. *E. coli* strain Nissle 1917 and vaccinia virus, e.g., a Lister strain of vaccinia virus such as LIVP, and derivatives thereof, are also particular microorganisms provided herein and that can be used in methods described herein. Particular bacteria for use in the methods include *Escherichia coli*, such as, for example, *E. coli* strains of the 06 serotype and *E. coli* strain Nissle 1917 and derivatives thereof, such as, for example, Nissle strains that either do not produce lipopolysaccharide (LPS), or that produce LPS that lacks the myristic acid moiety of lipid A, strains that lack one or more cryptic plasmids, such as pMut1 and/or pMut2, and strains in which the consensus nucleotide sequence for the Fur protein-binding region of the promoter of one or more genes that is negatively regulated by iron is inactivated.

The microorganisms, cells and compositions can be used in the preparation of a composition for detection, diagnosis or treatment of a disease or disorder, including, for example, proliferative conditions, neoplastic diseases, tumors, tumor tissue, cancer, metastasis, inflammation, wounds and infections. Such uses of the microorganisms, cells and compositions, which contain an amount effective for detection, diagnosis or treatment, are provided herein.

Compositions provided herein can also be used in methods of enriching microbial (such as, for example, bacterial) populations. Such enrichment methods include selecting for a recombinant feature, such as, for example, a metabolic feature, a marker, such as antibiotic resistance, a cell surface molecule that can be used as a ligand, or an intracellular protein that can be used as a ligand, using techniques known in the art and described below.

C. MICROORGANISMS AND CELLS SELECTED OR DESIGNED FOR A ENHANCED CAPACITY TO BIND, TRANSPORT, METABOLIZE, STORE AND/OR ACCUMULATE A METAL

Microorganism and cells provided herein and/or for use in the methods of detection and/or treatment provided herein are selected or designed to optimize and enhance detectability or therapeutic effect in a subject and/or to reduce toxicity or adverse effects on a subject that may result upon administration to a subject.

In a particular embodiment in which a microorganisms or cell for use in the methods provided herein is selected or designed to optimize and enhance detectability and/or therapeutic effect, the microorganism or cell is selected or designed for a substantial or enhanced capacity to bind, transport, metabolize, store and/or accumulate a metal, including, for example, iron. In another embodiment, the microorganism or cell is selected or designed for enhancing the capacity of a target cell or tissue to bind, transport, metabolize, store and/or accumulate a metal, including, for example, iron. Particular microorganisms or cells that can be used in such embodiments include, for example, a virus or intracellular bacterium containing nucleic acid that encodes one or more products involved in production of a metal (e.g., iron) storage, metabolism, binding or transport molecule. In yet another embodiment, the microorganism or cell is designed such that it expresses a heterologous surface peptide or protein that provides a site for specific interaction with an administered molecule, substance or composition that is directly or indirectly detectable and/or is therapeutic in the treatment of a proliferative site or condition or a disease, disorder or condition as described herein. Other examples are provided throughout the specification, and the compositions and methods can be combined to optimize detection and/or therapy of proliferative sites and conditions, and diseases, disorders and conditions as described herein. Administration of microorganisms or cells as provided herein can result in increased detectability or imaging capacity, the ability to detect or image target sites using a lower concentration of microorganisms or cells, increased therapeutic effect at sites of proliferation, increased killing of tumor cells, delays in the progression of a disease, disorder or condition and/or prolonging of survival of a subject afflicted with a disease, disorder or condition as described herein.

A microorganism or cell selected or designed for a substantial or enhanced capacity to bind, transport, metabolize, store and/or accumulate a metal can naturally exhibit such properties or can be engineered to have such attributes.

Microorganisms and cells can be recombinantly engineered to express or over-express one or more endogenous gene(s) to express proteins or molecules (e.g. those that (1) bind iron, (2) transport iron, (3) store iron, or a combination thereof), that increase the capacity of imaging a tumor or tissue in which the microorganisms or cells accumulate, or that depletes iron from the environment, thereby starving a tumor of a nutrient. In another example, nanoparticles or siderophores conjugated to a detectable moiety, a therapeutic agent or a combination thereof can be administered concurrent with, or subsequent to, the recombinantly engineered microorganism or cell, where the nanoparticles or siderophores then localize to the microorganism or cell. In yet another example, the microorganism or cells provided herein can be recombinantly engineered to over-express an exogenous recombinant gene, such as, for example, ompA carrying binding peptide(s) in permissible sites, via which ligands will bind and accumulate a diagnostic agent or a therapeutic agent, thereby imaging the tumor or tissue or cause an inhibition/killing of the tissues or cells in which the microorganism or cell accumulates.

1. Metal Binding, Acquisition, Transport, Metabolism, Storage and Regulation

Iron is important for life processes of all eukaryotes and most prokaryotes. In nature, iron exists as $Fe^{+2}$ (ferrous) or $Fe^{+3}$ (ferric) states. Iron, as the ferrous or ferric ion, is essential for the life processes of all eukaryotes and most prokaryotes; however, the element is toxic when in excess of that needed for cellular homeostasis. Although widely distributed, there is little free iron in vivo ($10^{-9}$ to $10^{-18}$ M). Highly efficient iron acquisition systems are used to scavenge iron from the environment under iron-restricted conditions.

In the mammalian body, iron is chelated to proteins or other molecules to maintain solubility, limit oxygen redox chemistry and limit availability to microbes. Chelates include transferrin (in serum and mucosa), lactoferrin (mucosa, milk) and heme containing proteins (e.g. hemoglobin), intracellularly stored in ferritin and ferritin-like molecules. Iron is stored in the ferritin and ferritin-like molecules until needed for cellular processes.

Bacteria need iron for growth, and successful bacterial pathogens have evolved to compete successfully for iron in the highly iron-stressed environment of the host's tissues and body fluids. Bacteria employ a variety of mechanisms to obtain iron for survival. Such mechanisms include scavenging iron from host carriers/sources, such as heme, hemoglobin, hemopexin and iron bound to transferring and lactoferrin, in addition to synthesis of iron-binding proteins such as siderophores, bacterial ferritin, bacterioferritin and dodecameric ferritin. In response to conditions of low iron, bacteria that do not produce siderophores have developed capabilities for scavenging iron from host carriers/sources (Wooldridge and Williams. *FEMS Microbiol. Rev.* 12(4): 325-348 (1993)).

a. Iron Storage

Mechanisms have evolved in living systems for iron detoxification and for the removal of excess ferrous ions from the cytosol. These detoxification mechanisms involve the oxidation of excess ferrous ions to the ferric state and storage of the ferric ions in ferritin-like proteins (Smith J L. *Crit. Rev. Microbiol.* 30(3): 173-185 (2004)). Organisms have evolved for existence in different environments and can possess ferritin-like compounds with different properties, such as higher affinity for iron or other metals. Metals other than iron, such as Gallium-67 ($Ga^{+3}$), have been shown to be able to be bind and be incorporated into ferritins. $Ga^{+3}$ is virtually irreducible under physiological conditions, which prevents it from entering heme, unlike $Fe^{+2}$ (Bernstein, *Pharmacol. Rev.* 50(4): 665-682 (1998); Chiancone et al. *Biometals.* 17(3): 197-202 (2004), Pulliainen et al. *Mol. Microbiol.* 57(4): 1086-1100 (2005); Reindel et al. *Biometals.* 18(4):387-397 (2005); Grove and Wilkinson. *J. Mol. Biol.* 347(3): 495-508 (2005)).

Highly efficient iron acquisition systems are used to scavenge iron from the environment under iron-restricted conditions. Bacterial iron storage proteins provide intracellular iron reserves for use when external supplies are restricted. The expression of the iron homeostatic machinery is subject to iron-dependent global control ensuring that iron acquisition, storage and consumption are geared to iron availability and that intracellular levels of free iron do not reach toxic levels (Andrews et al. *FEMS Microbiol. Rev.* 27(2-3): 215-237 (2003)). Ferritin-like compounds not only protect bacterial cells from iron overload, but they also serve as an iron source when iron is limited, protect the bacterial cells against oxidative stress and/or protect DNA against enzymatic or oxidative attack (Smith J L. *Crit. Rev. Microbiol.* 30(3): 173-185 (2004)).

Ferritins are a class of iron storage and mineralization proteins found throughout the animal, plant and microbial kingdoms. Iron is stored within the protein shell of ferritin as a hydrous ferric oxide nanoparticle with a structure similar to that of the mineral "ferrihydrite."

i. Prokaryotic Ferritins

Ferritins control the reversible transition between hydrated $Fe^{+2}$ in solution and the solid $Fe^{+3}$ mineral core inside its cavity and stores the resulting ferric ions in a non-reactive state, thereby protecting bacteria (prokaryotic and eukaryotic) from iron-induced oxidative damage. Ferritins differ with respect to their iron binding capacity and basic structure (J L Smith. *Crit. Rev. in Microbiol.* 30: 173-185 (2004)).

Ferritin-like proteins are widespread in bacteria, with at least 39 examples known. Some bacteria contain two bacterioferritin subunits, or two ferritin subunits, that in most cases co-assemble. Others possess both a bacterioferritin and a ferritin, while some appear to lack any type of iron-storage protein (Andrews S C. *Adv. Microb. Physiol.* 40: 281-351 (1998)).

There are at least four types of ferritin-like proteins in bacteria: bacterial ferritin, bacterioferritin, dodecameric ferritin, and rubrerythrins. These bacterial proteins are related to the ferritins found in eukaryotes. The importance of iron to bacteria can be illustrated in the diversity in number and types of these ferritin-like proteins in various bacteria (S C Andrews. *Advances in Microbial Physiology* 40: 281-351 (1998)). Table 1 lists a representative sampling of ferritin-like proteins in a variety of bacterial species.

TABLE 1

Diversity of ferritins, bacterioferritins and rubrerythrins

| Species | Ferritins | Bacterio-ferritins | Rubrerythrins | Dps ferritins |
|---|---|---|---|---|
| A. eutrophus | | 1 | | |
| A. fulgidus | 1 | | 4 | |
| A. chroococcum | | 1 | | |
| A. tumefaciens | | | | 1 |

TABLE 1-continued

Diversity of ferritins, bacterioferritins and rubrerythrins

| Species | Ferritins | Bacterio-ferritins | Rubrerythrins | Dps ferritins |
|---|---|---|---|---|
| A. vinelandii | | 1 | | |
| B. anthracis | | | | 1 |
| B. fragilis | 1 | | | |
| B. melitensis | | 1 | | |
| C. jejuni | 1 | | | 1 |
| C. acetobutylicum | 1 | 1 | 1 | |
| C. perfringens | | | 1 | |
| D. vulgaris | | | 2 | |
| E. coli | 2 | 1 | | 1 |
| H. pylori | 1 | | | 1 |
| H. influenzae | 2 | | | |
| M. magnetotacticum | | 2 | | |
| M. thermoautotrophicum | 1 | | | 2 |
| M. smegmatis | | | | 1 |
| M. jannaschii | | | 1 | |
| M. avium | | 1 | | |
| M. leprae | | 1 | | |
| M. paratuberculosis | | 1 | | |
| M. tuberculosis | 1 | 1 | | |
| N. gonorrhoeae | | 2 | | |
| N. meningitides | | 2 | | |
| N. winogradskii | | 1 | | |
| P. aeruginosa | | 2 | | |
| P. gingivalis | 1 | | | 1 |
| P. putida | | 1 | | |
| R. capsulatus | | 1 | | |
| R. sphaeroides | | 1 | | |
| R. rubrum | | 1 | | |
| S. mutans | | | | 1 |
| S. suis | | | | 1 |
| S. PCC6803 | | 2 | | |
| T. maritime | 1 | | 1 | |
| V. cholerae | 1 | 1 | | |

Data from (1) S C Andrews. *Advances in Microbial Physiology* 40: 281-351 (1998) and J L Smith. *Crit. Rev. Microbiol.* 30: 173-185 (2004).

In addition to the diversity of numbers and types of ferritin-like proteins, the proteins vary with respect to function depending upon the bacteria in which they are found. A representative sampling of ferritin-like proteins and associated functions is presented Table 2.

TABLE 2

Function of prokaryotic ferritin-like proteins

| Bacterial Species | Ferritin-like Compound(s) | Function(s) |
|---|---|---|
| A. tumifaciens | Dodecameric ferritin | Binds iron |
| | | Protects against $H_2O_2$ |
| B. anthracis | Dodecameric ferritin | Binds iron |
| | | Protects against iron over-load |
| B. melitensis | Bacterioferritin | Binds iron |
| | | Induces a Th1 response |
| C. jejuni | Bacterial ferritin | Binds iron |
| | | Serves as an iron source |
| | | Protects against $H_2O_2$ |
| | Dodecameric ferritin | Binds iron |
| | | Protects against $H_2O_2$ |
| E. coli | Bacterioferritin | Binds iron |
| | Bacterial ferritin | Binds iron |
| | | Serves as an iron source |
| | Dodecameric ferritin | Binds iron |
| | | Binds DNA |
| | | Serves as an iron source |
| | | Protects DNA against cleavage by $H_2O_2$:Fe |
| H. pylori | Bacterial ferritin | Binds iron |
| | | Protects against Fe + 2, Cu + 2 and Mn + 2 overload |
| | | Necessary for colonization of gastric mucosa |
| | Dodecameric ferritin | Binds iron |
| | | Binds DNA |
| | | Activates neutrophils and monocytes |
| | | Protects against oxygen toxicity |
| M. smegmatis | Dodecameric ferritin | Binds iron |
| | | Binds DNA |
| | | Protects DNA against cleavage by $H_2O_2$:Fe and DNaseI cleavage |
| N. gonorrhoeae | Bacterioferritin | Binds iron |
| | | Serves as an iron source |
| | | Protects DNA against cleavage by $H_2O_2$ and paraquat |
| P. gingivalis | Bacterial ferritin | Binds iron |
| | | Serves as an iron source |
| | Dodecameric ferritin | Binds iron |
| | | Binds DNA |
| | | Protects against $H_2O_2$ |
| P. aeruginosa | Bacterioferritin | Binds iron |
| | | Protects against $H_2O_2$ |

TABLE 2-continued

Function of prokaryotic ferritin-like proteins

| Bacterial Species | Ferritin-like Compound(s) | Function(s) |
|---|---|---|
| P. putida | Bacterioferritin | Binds iron |
| S. mutans | Dodecameric ferritin | Binds iron |
| | | Protects against $O_2$ and $H_2O_2$ |
| S. suis | Dodecameric ferritin | Binds iron |
| | | Protects against $H_2O_2$ |

Information from JL Smith. Crit. Rev. Microbiol. 30: 173-185 (2004).
Note:
The content of this table is not meant to be exhaustive. Any other similar ferritin-like compounds from other bacterial strains, which are not listed in this table, are also considered to be included.

Bacteria can be recombinantly engineered to express genes encoding prokaryotic ferritins and/or ferritin-like molecules (e.g., Bacterial ferritin, Bacterioferritin, Dodecameric ferritin, and Rubrerythrins), including but not limited to examples of prokaryotic ferritins and/or ferritin-like molecules listed herein. The prokaryotic ferritins and/or ferritin-like molecules can be endogenous to the bacteria, or can be exogenous (e.g., from another bacteria), or a combination thereof. The bacteria can be an extracellular bacteria or an intracellular bacteria. In one example, bacteria, such as E. coli Nissle 1917, can be recombinantly engineered to express genes encoding prokaryotic ferritins and/or ferritin-like molecules. The prokaryotic ferritins and/or ferritin-like molecules can be endogenous to E. coli Nissle 1917, or can be exogenous (e.g., from another bacteria), or a combination thereof.

Optionally, bacteria can be recombinantly engineered to over-express ferritin-like compounds and/or remove transcriptional iron-repression systems in addition to expression of iron acquisition systems. In a further embodiment, the bacteria can be recombinantly engineered to express or over-express one or more siderophores (endogenous or exogenous), one or more outer membrane proteins or transport proteins, or a combination thereof as described elsewhere in this application to increase iron acquisition, transport and storage. These methods can be combined with any of the other methods provided herein.

Bacteria (e.g., E. coli Nissle 1917) recombinantly engineered as described herein can be administered for accumulation in tumors and other hyperproliferative tissue, such as caused by inflammation, wounds, and infections. Increased iron uptake and/or storage can result in increased contrast for visualization and detection. Administration of labeled metals can also be used to increase contrast for any of the imaging methods described herein. Additionally, labeled methods can also be used for therapeutic purposes, such as, for example, radiolabeled iron, to specifically target a tumor.

Tumor tissues can be specifically infected by intravenously injected bacteria (e.g., E. coli Nissle 1917) recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis in tumor cells and delaying tumor progression and/or killing the tumor.

Additionally, iron, or other labeled metals, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor, wound, area of inflammation or infection allows the internalization of iron alone, a supplemental imaging moiety, or a therapeutic agent (which can deliver cytotoxicity specifically to tumor cells or deliver the therapeutic agent for treatment of the wound, area of inflammation or infection). These methods can be combined with any of the other methods provided herein.

(a) Bacterial Ferritin

Bacterial ferritin has a tetracosameric structure, and each subunit is approximately 19.5 kDa for an overall approximate molecular weight of 465 kDa. The cavity of bacterial ferritin can hold approximately 2500 iron atoms.

Iron enters ferritin as $Fe^{+2}$ and is oxidized to insoluble $Fe^{+3}$. For example, ferritins bind soluble $Fe^{+2}$ use oxygen as the electron acceptor and catalyze its oxidation to di-ferric compounds. The insoluble ferric ions are deposited in the central cavity, forming a ferrihydrite core (Wandersman and Delepelaire. Ann. Rev. Microbiol. 58: 611-647 (2004)). Release of iron from ferritin occurs through reduction and exit through a channel in the molecule.

Bacterial ferritin can be found in bacterial species including, but not limited to, C. jejuni, E. coli, H. pylori and P. gingivalis. The ferritin protein, Pfr, of H. pylori has been shown to be homologous to eukaryotic and prokaryotic ferritins (Choe et al. Helicobacter. 6(1): 55-59 (2001)). The function of the non-heme ferritin of E. coli (EcFtnA) is similar to recombinant human H chain ferritin (HuHF), in that it oxidizes $Fe^{+2}$ at a dinuclear ferroxidase center situated at a central position within each subunit. Iron is more evenly distributed between molecules in the bacterial ferritins than the mammalian ferritins, which can account for its greater accessibility (Bauminger et al. Biochemistry. 38(24): 7791-7802 (1999)).

Bacteria can be recombinantly engineered to express genes encoding one or more bacterial ferritins. In one example, bacteria, such as E. coli Nissle 1917, can be recombinantly engineered to express genes encoding a bacterial ferritin. In a further embodiment, bacteria can be transformed with multiple plasmids having genes encoding one or more ferritin-like molecules that are endogenous and/or exogenous to the bacteria. For example, bacteria, such as E. coli Nissle 1917, can be recombinantly engineered to express or over-express genes encoding bacterioferritin, dodecameric ferritin, rubrerythrin and/or high copy plasmids having genes encoding the eukaryotic H chain, L chain or H and L chains. In a further embodiment, bacteria, such as E. coli Nissle 1917, can be recombinantly engineered to express or over-express one or more siderophores (endogenous or exogenous), no siderophores, one or more outer membrane proteins, transport proteins or a combination thereof as described elsewhere to increase iron acquisition and transport of iron. These methods can be combined with any of the other methods provided herein.

(b) Bacterioferritin

Bacterioferritin (Bfr) has a tetracosameric structure, the cavity of which can hold approximately 1800 iron atoms. Bacterioferritin differs from bacterial ferritin and mammalian ferritin in that it contains heme located between each two subunits with a methionine from each subunit serving as the heme ligand Thus, each bacterioferritin molecule binds 12 hemes. Bacterioferritins bind soluble $Fe^{+2}$, use peroxide as the electron acceptor and catalyze its oxidation to di-ferric compounds. The insoluble ferric ions are deposited in the central cavity, forming a ferrihydrite core (Wandersman and Delepelaire. *Ann. Rev. Microbiol.* 58: 611-647 (2004)). Many bfr genes are associated with a bfd gene that encodes the Bfr-associated ferroxidin (Bfd), which plays a role in intracellular reduction of ferrichrome (Andrews et al. *FEMS Microbiol. Rev.* 27: 215-237 (2003)).

Bacterioferritin can be found in bacteria including, but not limited to, *Brucella melitensis, E. coli, Neisseria gonorrhoeae, Magnetospirillum magnetotactum, Trepdnema pallidum, Azobacter vinelandii, Pseudomonas aeruginosa* and *Pseudomonas putida*. The size of the subunits and 24 mers varies slightly from species to species as described in Table 3.

known as the ferroxidase center. Oxidation of two $Fe^{+2}$ per $H_2O_2$ occurs at the ferroxidase center, thereby avoiding hydroxyl radical production and most of the $H_2O_2$ produced from $O_2$ is rapidly consumed in a subsequent ferroxidase reaction with $Fe^{+2}$ to produce $H_2O$. Bacterioferritins facilitate the pair-wise oxidation of $Fe^{+2}$ by $H_2O_2$, thereby avoiding odd electron reduction products of oxygen and oxidative damage to the protein and cellular components (Bou-Abdallah et al. *J. Biol. Chem.* 277(40): 37064-37069 (2002)).

The nucleotide sequence of the *Rhodobacter capsulatus* bacterioferritin gene (bfr) was determined and found to encode a protein of 161 amino acids with a predicted molecular mass of 18,174 Da. Amino acids that are involved in heme ligation, and those that provide ligands in the binuclear metal centre in bacterioferritin from *E. coli* are conserved in the *R. capsulatus* protein (Penfold et al. *FEMS Microbiol Lett.* 139 (2-3): 143-148 (1996)).

Bacterioferritin (Bfr) from *Neisseria gonorrhoeae* strain F62 has been identified in cell-free extracts. Gonococcal Bfr has an estimated molecular mass of 400 kDa and is composed of 18 kDa (BfrA) and 22 kDa (BfrB) subunits. The two gonococcal bfr genes are located in tandem with an intervening gap of 27 bp. A potential Fur-binding sequence (12 of 19 bp identical to the consensus neisserial fur sequence) was identified within the 5' flanking region of bfrA in front of a

TABLE 3

Characteristics of bacterioferritins

| Species | Size (kDa) Subunit | Size (kDa) 24-mer | Hemes/ holomer | Fe atoms/ holomer | Fe:Phosphate (mole:mole) | Subunits (no. types) |
|---|---|---|---|---|---|---|
| E. coli | 18.5 | 452 | 12 | ~980 | 2.2:1 | 1 |
| P. aeruginosa | 18 and 18.5 | 430 | 3-9 | 700-800 | 1.7:1 | 2 |
| A. vinelandii | 18 | 443 | 12 | 600-2400 | 1.4:1 | Likely 1 |
| N. winogradski | 19.5 | 260 | 12 | ~100 | | 1 |
| R. spaeroides | 16 | >100 | 10 | | | 1 |
| R. rubrum | 23 | 450 | Yes | | | 1 |
| A. chroococcum | 17 | ~410 | Yes | | | 1 |
| Synechocystis | 19 | 400 | 6 | 2300 | 1.5:1 | 1 (or 2) |
| A. spinosa | 20 and 20 | ~480 | Yes | 750 | | 2 |
| R. capsulatus | 18.2 | 437 | 6 | 600-950 | 1.6-1.9:1 | 1 |

Data from SC Andrews. Advances in Microbial Physiology 40: 281-351 (1998)).

Organisms have evolved for existence in different environments and can possess ferritin-like compounds with different properties. For example, bacterioferritin of *Magnetospirillum magnetotactum* is a heterodimer compared to homodimeric bacterioferritin of *E. coli* (Bertani et al. Gene 264: 257-263 (2001)).

Bacterioferritin from *E. coli* is able to accumulate large quantities of iron in the form of an inorganic $Fe^{+3}$ mineral core. Iron uptake and storage by *E. coli* bacterioferritin involves both the core surface and the ferroxidase center. Core formation rates are pH- and $Fe^{+2}$-dependent and depend on the amount of iron already present in the core. Even at optimal pH (i.e., pH 6.5), the effective iron capacity is approximately 2700 per holomer, i.e., almost half of the theoretical limit of approximately 4500. Therefore, competing oxidation/precipitation processes have a major influence on the amount of iron accumulated (Baaghil et al. *Biochemistry* 42(47): 14047-14056 (2003)).

Bacterioferritin of *E. coli* is an iron-mineralizing heme-containing complex composed of 24 identical bacterioferritin proteins, each containing a di-nuclear metal-binding site putative −35 hexamer (Chen and Morse. *Microbiology.* 145 (Pt 10): 2967-2975 (1999)). The bfr gene has been introduced into an expression vector and produced to a high level in *E. coli* (Penfold et al. *FEMS Microbiol. Lett.* 139(2-3): 143-148 (1996)).

Bacteria can be recombinantly engineered to express genes encoding one or more bacterioferritins. In one example, bacteria, such as *E. coli* Nissle 1917, can be recombinantly engineered to express genes encoding a bacterioferritin. In a further embodiment, bacteria can be transformed with multiple plasmids having genes encoding one or more ferritin-like molecules that are endogenous and/or exogenous to the bacteria. For example, bacteria, such as *E. coli* Nissle 1917, can be recombinantly engineered to express or over-express genes encoding bacterial ferritin, dodecameric ferritin, rubrerythrin and/or high copy plasmids having genes encoding the eukaryotic H chain, L chain or H and L chains. In a further embodiment, bacteria, such as *E. coli* Nissle 1917, can be recombinantly engineered to express or over-express one or more siderophores (endogenous or exogenous), no siderophores, one or more outer membrane proteins, transport proteins or a combination thereof as described elsewhere to increase iron acquisition and transport of iron. These methods can be combined with any of the other methods provided herein.

(c) Dodecameric Ferritin

The dodecameric ferritin, Dps (DNA-binding proteins during stationary phase), of *E. coli* belong structurally to the ferritin super-family but differ from ferritins in their function and regulation. The Dps family members constitute a distinct group of multimeric and ferritin-like iron binding proteins (up to 500 iron atoms/12-mer) that have a role in regulating in oxidative stress resistance and virulence.

Iron ions in Dps molecules are oriented with tetrahedral symmetry where the tetrahedron center is occupied by iron ions and the vertices by oxygen. Similar to mammalian ferritins, iron in Dps molecules does not remain bound to the site after oxidation has taken place (Ilari et al. *J. Biol. Chem.* 277(40): 37619-37623 (2002)).

Dps is shown to be a Fe-binding and storage protein where $Fe^{+2}$ oxidation is most effectively accomplished by $H_2O_2$ rather than by $O_2$ (as is observed in ferritins). Two $Fe^{+2}$ ions bind at each of the 12 putative dinuclear ferroxidase sites in the protein. The ferroxidase site-bound iron is then oxidized, where two $Fe^{+2}$ are oxidized per $H_2O_2$ reduced, thus avoiding hydroxyl radical production.

Dps acquires a ferric core of approximately 500 $Fe^{+3}$ with a 2 $Fe^{+2}/H_2O_2$ stoichiometry. The protein forms a similar ferric core with $O_2$ as the oxidant, albeit at a slower rate. Dps attenuates hydroxyl radical production during $Fe^{+2}$ oxidation by $H_2O_2$ and the protective effect of Dps on DNA most likely is exerted through a dual action: the physical association with DNA and the ability to nullify the toxic combination of $Fe^{+2}$ and $H_2O_2$ (Wandersman and Delepelaire. *Ann. Rev. Microbiol.* 58: 611-647 (2004); Zhao et al. *J. Biol. Chem.* 277(31): 27689-27696 (2002)).

Dodecameric ferritin can be found in bacterial species such as, for example, *Agrobacterium tumifaciens, Bacillus anthracis, Campylobacter jejuni, E. coli, Helicobacter pylori, Mycobacterium smegmatis, Porphyromonas gingivalis, Listeria monocytogenes, Streptococcus mutans* and *Streptococcus suis*.

*E. coli* Dps is a 205 kDa Dodecameric sphere and can hold approximately 500 ferric ions in the central cavity. Ferritin-like compounds such as Dps proteins have been shown to (1) store iron, thereby protecting bacterial cells from iron overload, (2) serve as an iron source when iron is limited and/or (3) protect bacterial cells against oxidative attack. Two Dps present in the *B. anthracis* genome are homologous to *E. coli* Dps. The two proteins (Dlp-1 and Dlp-2) are sphere-like proteins with an internal cavity that act as ferritins and are thus involved in iron uptake and regulation (Wandersman and Delepelaire. *Ann. Rev. Microbiol.* 58: 611-647 (2004); Papinutto et al. *J. Biol. Chem.* 277(17): 15093-15098 (2002)).

Bacteria can recombinantly engineered to express genes encoding one or more dodecameric ferritins. In one example, a bacteria, such as *E. coli* Nissle 1917, can be recombinantly engineered to express genes encoding a dodecameric ferritin. In a further embodiment, bacteria can be transformed with multiple plasmids having genes encoding one or more ferritin-like molecules that are endogenous and/or exogenous to the bacteria. For example, bacteria, such as *E. coli* Nissle 1917, can be recombinantly engineered to express or over-express genes encoding a bacterioferritin, bacterial ferritin, rubrerythrin and/or high copy plasmids having genes encoding the eukaryotic H chain, L chain or H and L chains. In a further embodiment, bacteria, such as *E. coli* Nissle 1917, can be recombinantly engineered to express or over-express one or more siderophores (endogenous or exogenous), no siderophores, one or more outer membrane proteins, transport proteins or a combination thereof as described elsewhere to increase iron acquisition and transport of iron. These methods can be combined with any of the other methods provided herein.

(d) Rubrerythrins

Rubrerythrins are produced by anaerobic bacteria, are structurally-related to ferritins and exhibit ferroxidase activity similar to ferritins. Rubrerythrins are homodimeric, with each subunit being 22 kDa, and are found in anaerobic bacteria. Anaerobic bacteria used in the methods provided herein are those bacteria that do not require oxygen to survive and grow. In some embodiments, the bacteria must be in an oxygen-limiting (e.g., intratumor) or oxygen-free environment in order to survive and grow. Exemplary anaerobic bacteria provided herein include, but are not limited to, *A. fulgidus, C. acetobutylicum, C. perfringens, D. vulgaris, M. jannaschii, M. thermo-autotrophicum* and *T. maritime*.

In addition to rubrerythrins, some anaerobic bacteria have genes that encode other ferritin-like molecules. For example, *A. actinomycetemcomitans* has two genes, afnA and afnB that encode proteins that are similar to ferritin-like proteins of bacteria such as *E. coli*. The proteins encoded by afnA and afnB play a role in helping anaerobic bacteria adapt to oxidative environmental changes (Hirosue et al. *Microbiol. Immunol.* 45(10): 721-727 (2001)).

Bacteria can be recombinantly engineered to express genes encoding one or more rubrerythrins. In one example, bacteria, such as *C. perfringens*, can be recombinantly engineered to express afnA and afnB genes, the gene(s) encoding the one or more rubrerythrin(s), or a combination thereof. In a further embodiment, *C. perfringens* can recombinantly engineered to express genes encoding one or more ferritin-like molecules that are endogenous and/or exogenous to the bacteria. For example, *C. perfringens* can be recombinantly engineered to express genes encoding a bacterioferritin, a bacterial ferritin, a dodecameric ferritin and/or high copy plasmids having genes encoding the eukaryotic H chain, L chain or H and L chains. In a further embodiment, bacteria, such as *C. perfringens*, can be recombinantly engineered to express or over-express one or more siderophores (endogenous or exogenous), no siderophores, one or more outer membrane proteins, transport proteins or a combination thereof as described elsewhere to increase iron acquisition and transport of iron. These methods can be combined with any of the other methods provided herein.

ii. Eukaryotic Ferritins

Eukaryotic ferritins contain 24 subunits (M(r)~18,000 each) which define a rhombic dodecahedral protein shell that encloses up to 4000 iron atoms in an oxide/hydroxide/phosphate core (Grossman et al. *PNAS USA* 89: 2419-2423 (1992)). Eight hydrophilic channels that traverse the protein shell are thought to be the primary avenues by which iron gains entry to the interior of eukaryotic ferritins. Mammalian ferritins, have H and L chains, which have complementary functions in iron uptake. The H chain contains a dinuclear ferroxidase site that is located within the four-helix bundle of the subunit; it catalyzes the oxidation of ferrous iron by $O_2$, producing $H_2O_2$. The L subunit lacks this site but contains additional glutamate residues on the interior surface of the protein shell which produce a microenvironment that facilitates mineralization and the turnover of $Fe^{3+}$ at the H subunit ferroxidase site (Arosio et al. *J. Biol. Chem.* 253(12): 4451-4458 (1978); Chasteen and Harrison. *J. Struct. Biol.* 126(3): 182-194 (1999); Rouault and Klausner. *Curr. Top. Cell. Reg.* 35: 1-19 (1997)).

Also encompassed within are diagnostic and therapeutic methods using eukaryotic cells. Eukaryotic cells include cells from multicellular eukaryotes, including mammals such as primates, where exemplary cells are human cells. Typically the cells are isolated cells. For example, eukaryotic cells can be fibrosarcoma cells such as human fibrosarcoma cells. Exemplary human fibrosarcoma cells include HT1080 (ATCC Accession Nos. CCL-121, CRL-12011 or CRL-12012). In another example, eukaryotic cells can include stem cells, including mammalian stem cells such as primate stem cells, where exemplary primate stem cells are human stem cells.

Also provided herein are modifications of eukaryotic cells to enhance one or more characteristics relative to the wild type cells. Such characteristics can include, but are not limited to, increased capacity to capture and store iron.

Strategies for expression of recombinant rat liver H and L ferritin homopolymers in both prokaryotic and eukaryotic expression systems have been developed (Guo et al. *Biochem Biophys Res Commun.* 242(1): 39-45 (1998)). In another example, over-expression of recombinant human apoferritin heteromers (heavy (H) and light (L) chains) in *E. coli* used T7 RNA polymerase dependent expression, induced by isopropyl beta-D-thiogalactopyranoside (IPTG) and rifampicin (Grace et al. *Arch Biochem Biophys.* 384(1): 116-122 (2000)). In another example, inserting a ferritin gene into the plasmid pEMBLex2 has been shown to direct the synthesis of the ferritin H chain in *E. coli* up to a concentration of 15% of total soluble proteins with correct folding of the protein (Bereswill et al. *Microbiology.* 144 (Pt 9): 2505-2516 (1998); Hudson et al. *Eur. J. Biochem.* 218: 985-995 (1993); Levi et al. *Gene* 51(2-3): 269-274 (1987); Izuhara et al. *Mol. & Gen. Genet.* 225: 510-513 (1991)); Andrews et al. *Eur. J. Biochem.* 213: 329-338 (1993); Vieira and Messing. *Methods Enzymol.* 153: 3-11 (1987)).

In one embodiment, eukaryotic cells can be recombinantly engineered to over-express an H chain, an L chain, or a combination thereof. For example, human fibrosarcoma cells, for example, can be transfected with a plasmid carrying genes encoding H and L chains. In another embodiment, human fibrosarcoma cells can be transformed with plasmids carrying genes encoding bacterial ferritin. In a further embodiment, eukaryotic cells can be transformed with multiple plasmids having genes encoding one or more ferritins that are endogenous and/or exogenous to the cells. For example, eukaryotic cells can be transfected with plasmids carrying genes encoding one or more siderophores and/or one or more outer membrane proteins or transport proteins as described elsewhere herein to increase iron acquisition and transport of iron.

Tumor tissues can be specifically infected by intravenously injected recombinant eukaryotic cells and/or extracellular bacteria recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis in tumor cells and delaying tumor progression and/or killing the tumor. Additionally, iron or other metal, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Eukaryotic cell internalization of iron in the tumor environment allows the internalization of iron alone, a supplemental imaging moiety, or a therapeutic agent (which in turn delivers cytotoxicity specifically to the tumor cells).

iii. Viruses

Viruses can be used to recombinantly express any of the iron storage proteins in the tumor cell cytosol using methods described herein and known in the art. Delivery of such proteins to the tumor cell cytosol using a virus increases metal acquisition, which in turn, increases contrast agents that can be used for imaging of the tumor in vitro and/or in vivo. Administration of labeled metals can also be used to increase contrast for any of the imaging methods described herein. Additionally, labeled methods can also be used for therapeutic purposes, such as, for example, radiolabeled iron, to specifically target a tumor. Exemplary viruses provided herein that express a ferritin include GLV-1h82 and GLV-1h83.

In one non-limiting example, tumor tissues can be specifically infected by intravenously injected viruses (such as Vaccinia virus) recombinantly engineered to express genes encoding, for example, a H chain, a L chain, a transferrin receptor, or a combination thereof. Increased iron uptake and/or storage can result in, not only, increased contrast for visualization and detection, but also iron accumulation in the tumor cells. Iron accumulation in the tumor cells can be increased to toxic levels, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. In some cases where the imaging moiety and therapeutic agent are different, a sequential administration of conjugated iron is contemplated. Internalization of iron in the tumor cells allows the internalization of iron alone, a supplemental imaging moiety, or a therapeutic agent (which in turn delivers cytotoxicity specifically to the tumor cells).

b. Iron Acquisition and Transport

Iron acquisition systems of bacteria are generally of two-types: (1) synthesis of molecules, such as siderophores, that are released by a bacterium into the extracellular milieu and that scavenge iron or heme from various sources and (2) direct contract between a bacterium and exogenous iron/heme sources.

Bacteria can be recombinantly engineered to over-express iron acquisition systems. Acquired iron is stored in increased amounts in ferritin-like compounds such as bacterial ferritin, bacterioferritin and dodecameric ferritin, as described elsewhere herein. Optionally, bacteria can be recombinantly engineered to over-express ferritin-like compounds and/or remove transcriptional iron-repression in addition to expression of iron acquisition systems. Increased iron acquisition can result in, not only, increased contrast for visualization and detection of tumors and other hyperproliferative tissue, such as caused by inflammation, wounds, and infections, but also iron depletion from cells, such tumor cells and/or the tumor environment. Iron depletion from tumor cells and/or the tumor environment removes a vital nutrient from the tumors, thereby dis-regulating iron hemostasis and delaying tumor progression and/or killing the tumor.

Bacteria can be used to label tumors with an imaging moiety, a therapeutic agent, or a combination thereof. For example, tumor tissues can be specifically infected by intravenously injected bacteria which acquire iron through a variety of mechanisms thereby producing a contrast agent that can be visualized using the methods described herein. Administration of labeled metals can be used to increase contrast for any of the imaging methods described herein. Additionally, iron, or other labeled metals, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor, wound, area of inflammation or infection allows the internalization of iron alone, a supplemental imaging moiety, or a therapeutic agent (which can deliver cytotoxicity specifically to tumor cells or deliver the therapeutic agent for treatment of the wound, area of inflammation or infection). These methods can be combined with any of the other methods provided herein.

i. Siderophores

Plants, bacteria, fungi, and yeast use organic siderophores, which are iron chelators, to establish commensal and pathogenic relationships with hosts and to survive as free-living organisms. Siderophores solubilize iron from mineral complexes in the environment and/or compete iron from transferrin and lactoferrin in a host, such as a vertebrate host, under conditions of iron limitation (Ferguson and Deisenhofer. *Biochim. Biophys. Acta.* 1565(2): 318-332 (2002); Raymond et al. *PNAS USA.* 100(7): 3584-3588 (2003); Drechsel and Jung. *J. Pept. Sci.* 4(3): 147-181 (1998); Braun and Braun. *FEBS Lett.* 529(1): 78-85 (2002); G. Winkelmann. *Biochem. Soc. Trans.* 30(4): 691-696 (2002)). Exemplary siderophores from a multitude of bacterial species are presented in Table 4.

TABLE 4

| Bacterial Species | Endogenous siderophores | Exogenous siderophores | Host iron compounds |
|---|---|---|---|
| *A. pleuropneumoniae* | | | Transferrin |
| *A. hydrophila* | Amonobactins | | |
| *A. salmonicida* | Salmonicida siderophore | | Transferrin, lactoferrin |
| *Bacteroides* spp. | | | Transferrin |
| *B. pertussis* | | | Transferrin, ovotransferrin, lactoferrin |
| *C. jejuni* | | Enterochelin | Heme, hemoglobin |
| *Citrobacter* spp. | Aerobactin | | |
| *C. diphtheriae* | corynebacterial siderophore | Aerobactin | |
| *Erwinia* spp. | Ferrioxamine-type | | |
| *E. coli* | Enterochelin, dihydroxybenzoic acid, dihydroxy-benzoylserine, aerobactin | Ferrichrome, ferricrysin, ferricrosin, coprogen, rhodotorulic acid, citrate, ferrioxamine | Heme |
| *E. coli* Nissle 1917 | Enterobactin, aerobactin, yersiniabactin, salmochelin | | Heme |
| *H. influenzae* | | Enterochelin | Heme, hemoglobin, transferring |
| *H. parainfluenzae* | | Enterochelin | |
| *H. paraphrophilus* | | Enterochelin | |
| *H. somnus* | | | Transferrin |
| *Hafnia* spp. | Ferrioxamine-type | Aerobactin | |
| *K. pneumoniae* | Aerobactin, enterochelin, ferrioxamine-type | Aerobactin | |
| *Morganella* spp. | α-Keto acids, α-hycroxycarboxylic acids | Aerobactin | |
| *M. neoaurum* | Exochelin, mycobactin | | |
| *M. smegmatis* | Exochelin, mycobactin | | |
| *M. leprae* | Exochelin | | |
| *N. meningitides* | | | Heme, hemoglobin, transferrin, lactoferrin |
| *N. gonorrhoeae* | | Aerobactin | Heme, hemoglobin, transferrin, lactoferrin |
| *Pantoea* spp. | Ferrioxamine-type | | |
| *Proteus* spp. | α-Keto acids, α-hycroxycarboxylic acids, aerobactin | | |
| *Providencia* spp. | α-Keto acids, α-hydroxycarboxylic acids | | |
| *P. aeruginosa* | Pyoverdin, pyochelin | Enterochelin | |

TABLE 4-continued

| Bacterial Species | Endogenous siderophores | Exogenous siderophores | Host iron compounds |
|---|---|---|---|
| Salmonella spp. | Enterochelin, aerobactin, hydroxamate-type | | |
| Serratia spp. | Aerobactin | | Heme |
| Shigella spp. | Enterochelin, aerobactin | | |
| S. aureus | Staphylobactin | | |
| S. epidermidis | Staphylobactin | | |
| S. hyicus | Staphyloferrin A, B | | |
| V. anguillarum | Anguibactin, enterochelin | | |
| V. cholerae | Vibriobactin | | Heme, hemoglobin |
| V. vulnificus | Catechol-type, hydroxamate-type | | |
| Yersinia spp. | Yersiniabactin | Aerobactin | Heme, hemoglobin |

Note:
The content of this table is not meant to be exhaustive. Any other similar siderophores from other bacterial strains, which are not listed in this table, are also considered to be included.

The structure of siderophores is highly diverse; siderophores can be proteinaceous or small organic molecules. Pathogenic bacteria are highly flexible and can use siderophores produced by other organisms, but which they do not themselves make (Neilands J B. *Microbiol. Sci.* 1(1): 9-14 (1984)). Proteins, such as the biosynthetic enzymes that make siderophores, can be encoded in the bacterial genome or on a plasmid. Exemplary siderophore biosynthetic enzymes include synthetases, such as non-ribosomal peptide synthetases (NRPS).

Bacteria have developed numerous systems to transfer iron from the extracellular milieu to the intracellular environment. For example, siderophore-iron complexes can be transported into the cell cytosol by membrane receptor and transport systems including, but not limited to, outer membrane proteins, ABC transporters and TonB receptors (Crosa J H. *Microbiol. Rev.* 53(4): 517-30 (1989); Rohde and Dyer. *Frontiers in Bioscience* 8: d1186-d1218 (2003)). In Gram-negative bacteria, iron usually transported through a specific outer membrane receptor. In Gram-positive bacteria, a receptor protein is usually anchored by a covalently linked lipid and a periplasmic transport protein and several inner membrane-associated proteins complete the transport of iron into the bacterial cell, using, for example, an ABC transporter. Bacterial iron uptake systems are diverse and use a combination of extracellular, membrane-bound and intracellular proteins to uptake and store iron (Clarke et al. *Current Topics in Medicinal Chemistry* 1: 7-30 (2001)).

Provided herein are bacteria that over-express siderophores, including but not limited to the siderophores described herein. The siderophores can be endogenous to the bacterium, exogenous to the bacteria, or a combination thereof. The bacteria can be an intracellular bacterium or an extracellular bacterium. Increased expression and secretion of the siderophores results in increased iron acquisition by the bacterium, or the bacteria surrounding it. The bacteria can be engineered to over-express the siderophores using any method known in the art or provided herein. In one non-limiting example, the bacteria is recombinantly engineered to express or over-express one or more siderophore(s). In one embodiment, bacteria can be recombinantly engineered to overexpress a siderophore. Also provided herein are bacteria that have been engineered to inactivate transcriptional iron suppression using any method known in the art or provided herein.

Tumor tissues can be specifically infected by intravenously injected microorganisms and cells recombinantly engineered to express or over-express any of the siderophores provided herein, thereby creating iron uptake systems or supplementing a bacteria's own iron uptake and storage, thereby increasing iron acquisition by the microorganism. Increased iron acquisition can result in, not only, increased contrast for visualization and detection, but also iron depletion from the tumor environment.

In a further embodiment, iron or iron-loaded siderophores can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells). These methods can be combined with any of the other methods provided herein.

Provided herein are compositions of *E. coli* Nissle 1917 bacteria that over-express exogenous siderophores. *E. coli* Nissle 1917, can be recombinantly engineered to over-express iron-acquiring mechanisms from other bacteria to complement its own iron-acquiring systems. Expression and secretion of the exogenous siderophores increases iron acquisition by the bacteria. Increased iron acquisition can result in, not only, increased contrast for visualization and detection, but also iron depletion from the tumor environment as described above. The bacteria can be engineered to over-express the siderophores using any method known in the art or provided herein. In one non-limiting example, *E. coli* Nissle 1917 are transformed with high copy plasmids having genes encoding proteins involved in siderophore biosynthesis. Also provided herein are *E. coli* Nissle 1917 that have been further engineered to inactivate transcriptional iron suppression using any method known in the art or provided herein. For example, *E. coli* Nissle 1917 can be recombinantly engineered to remove transcriptional iron-repression by mutation or deletion of all or part of the fur consensus sequence using any method known in the art or provided herein. Optionally, *E. coli* Nissle 1917 can also be recombinantly engineered to over-express ferritin-like compounds. These methods can be combined with any of the other methods provided herein.

In one embodiment, tumor tissues can be specifically infected by intravenously injected *E. coli* Nissle 1917 recombinantly engineered to over-express siderophores, including but not limited to the siderophores described herein, to complement their own iron-acquiring systems. Such engineered bacteria can be used in any of the methods provided herein.

In another embodiment, bacteria can be recombinantly engineered to inactivate the genes involved in siderophore biosynthesis. In one non-limiting example, tumor tissues can be specifically infected by intravenously injected bacteria (e.g., *E. coli* Nissle 1917) recombinantly engineered to have inactivated siderophore-expressing systems, but retain functional receptors and/or transporters that bind siderophores. Concomitantly with, or subsequent to, administration of the bacteria, iron-loaded exogenous siderophores can be systemically administered such that the siderophores specifically hone to the bacteria. The iron-loaded siderophores can further be conjugated to a detectable and/or therapeutic label.

(a) Gram Negative Bacteria

Gram negative bacteria produce a wide variety of siderophores, use siderophores from other bacteria, and employ a variety of receptors to uptake and store iron. Generally, siderophores are proteinaceous or small organic molecules.

(1) Peptide Siderophores

The peptidic backbone of siderophores combined with non-proteinogenic amino acid units embedded in the iron chelators indicates that some siderophores have a non-ribosomal peptide compound structure. Many of the proteins involved in biosynthesis of siderophores are non-ribosomal peptide synthetases (NRPS), which are multi-modular enzymes that produce peptide products having a particular sequence in the absence of an RNA template. The order of monomeric amino acids that are activated and incorporated is dictated by the order of NRPS domains, and the chains grow as a series of intermediates covalently tethered to the NRPS domains by peptidyl carrier protein domains (Crosa and Walsh. *Microbiol. Mol. Biol. Rev.* 66(2): 223-249 (2002); Quadri L E. *Mol. Microbiol.* 37(1): 1-12 (2000)). Proteinaceous siderophores from a variety of bacterial species are presented in Table 4.

a. Oligopeptide-Containing Siderophores

Siderophores that are most similar to peptides contain amino acids in a sequence of α-amino acids that are linked via underivatized peptide bonds between carboxy and α-amino groups. Side chains of this type of siderophore bind to ferric ions.

Oligopeptide-containing siderophores include, for example, members of the ferrichrome family. Ferrichrome siderophores are cyclohexapeptides of three side-chain derivatized L-ornithines and three other amino acids (glycine, L-serine or L-alanine).

Pyoverdins and pseudobactins are fluorescent peptide siderophores that are largely produced by the Pseudomonad family. Ferribactins, also produced by Pseudomonads, are likely precursors of pyoverdins. Azobactins share a peptidic component with pyoverdins, but differ with respect to the N-terminal chromophore. A variety of chromophores that are N-acylations of pyoverdins include, for example, malic acid and succinic acid. Ornibactins are pyoverdin-like siderophores in their oligopeptide component, but lack a chromophore and carry different β-hydroxy fatty acids on the N-hydroxylated side chains of the N-terminal ornithine. Provided herein are bacteria that over-express siderophores, such as oligopeptide-containing siderophores. In one embodiment, bacteria can be recombinantly engineered to overexpress a siderophore, such as pyoverdin.

The genes encoding synthesis and uptake of pyoverdins are clustered in the pvd region of the Pseudomonad genome and are regulated by the promoter region pvdS. The promoter region has been shown to match the consensus binding side of *E. coli* Fur protein and transcription of the pvd region is iron-repressible similar to *E. coli* (Drechsel and Jung. *J. Pept. Sci.* 4(3): 147-181 (1998)). In one non-limiting example, the bacterium, such as *Pseudomonas aeruginosa*, can be recombinantly engineered to remove transcriptional iron-repression by deleting all or part of the pvdS promoter region, and transformed with plasmids encoding proteins involved in siderophore biosynthesis and/or ferritin-like compounds.

In another embodiment, tumor tissues can be specifically infected by intravenously injected *P. aeruginosa* recombinantly engineered to acquire iron via expression or overexpression of siderophores in the absence of transcriptional regulation. Alternatively, or in addition, *P. aeruginosa*, can be recombinantly engineered to over-express one or more siderophores.

b. Siderophores with Side-Chain-Connected Amino Acids Along the Backbone

Siderophores can contain amino acids connected to side chains of the peptide back bone. Fusarinines are a class of hydroxamate siderophores constructed of N5-acyl-N5-hydroxy-L-ornithine and anhydromevalonic acid, and have been isolated from a variety of fungi. Amonabactins, on the other hand, are bacterial catecholate siderophores having amino groups acylated with 2,3-dihydroxybenzoic acid with or without a glycine reside. Biosynthesis of 2,3-dihydroxybenzoic acid is functionally similar to the 2,3-dihydroxybenzoic acid operon of *E. coli* (Drechsel and Jung. *J. Pept. Sci.* 4(3): 147-181 (1998)). Provided herein are bacteria that overexpress siderophores, such as siderophores that contain amino acids connected to side chains of the peptide backbone. In one embodiment, bacteria can be recombinantly engineered to overexpress a siderophore, such as amonabactin.

c. Siderophores with Amino Acids Acting as Functional Carriers for Chelating Groups Another group of siderophores are those with amino acids acting as functional carriers for chelating groups, one of which is enterobactin. Enterobactin (also known as enterochelin) is a tricatecholate siderophore that can be found in *E. coli* and other enterobacteriaceae. Chelating groups of enterobactin result from three residues of 2,3-dihydroxybenzoic acid (DHBA) anchored on a skeleton of the cyclotriester of L-serine. 2,3-dihydroxybenzoic acid is formed from chorismate by the gene products of entC, which encodes an isochorismate synthetase, entB, which encodes 2,3-dihydro-2,3-dihydroxybenzoate synthetase, and entA, which encodes 2,3-dihydro-2,3-dihydroxybenzoate dyhydrogenase. Proteins encoded by genes entD, entE, entF, together with an assembly activity located at the carboxy terminus of entB, catalyze the formation of the enterobactin molecule from three molecules each of 2,3-dihydroxybenzoic acid and L-serine. Further, transport of ferric enterobactin into the bacterial cell cytosol requires additional genes, such as the fepB, fepC, fepD, fepE and fepG genes which uptake ferric enterobactin through the periplasm and cytoplasmic membrane, fepA (encodes the outer membrane receptor) and fes (intracellular release of iron from enterobactin; Crosa and Walsh. *Microbiol. and Molec. Biol. Reviews* 66(2): 223-249 (2002)).

Other siderophores related catecholate siderophores include, for example, protochelin, azotochelin and aminochelin, whereas staphyloferrin A is a member of the carboxylate class of siderophores; however, each has amino acids acting as functional carriers for chelating groups (Drechsel and Jung. *J. Pept. Sci.* 4(3): 147-181 (1998)).

Provided herein are bacteria that over-express siderophores, such as siderophores with amino acids acting as functional carriers for chelating groups. In one embodiment, bacteria can be recombinantly engineered to over-express a siderophore, such as enterobactin.

In one embodiment, extracellular bacteria, such as *E. coli* Nissle 1917, can also be recombinantly engineered to over-express entABC and entDEF gene products, thereby increasing production of enterobactin. Further, bacteria can be recombinantly engineered to over-express endogenous iron acquiring mechanisms including, but not limited to, transport of ferric enterobactin into the bacterial cell cytosol requires additional genes, such as the fepB, fepC, fepD, fepE and fepG genes which uptake ferric enterobactin through the periplasm and cytoplasmic membrane, fepA which encodes the outer membrane receptor and fes which encodes intracellular release of iron from enterobactin.

d. Siderophores Containing Cyclized Amino Acids

Some siderophores contain cyclized amino acids. Such siderophores include, for example, agrobactin, parabactin, fluvibactin, vibriobactin, vulnibactin, anguibactin, acinetobactin, mycobactin, exochelin, maduraferrin, pyochelin and yersiniabactin. Agrobactin and parabactin are structurally similar to protochelins. Analogs of agrobactin and parabactin include, for example, fluvibactin, vibriobactin and vulnibactin. Others in the same class include acinetobactin, which is a monocatecolate/monohydroxamate siderophore containing 2,3-dihydroxybenzoic acid (DHBA) as part of the structure. Anguibactin is a thiazoline analog of acinetobactin.

The genes for the biosynthesis of 2,3-dihydroxybenzoic acid are located on the chromosome of *Vibrio anguillarum*, whereas the genes for anguibactin expression are plasmid-mediated. Two regions of the *Vibrio cholerae* chromosome are involved with vibriobactin-mediated iron uptake: one cluster contains the vibriobactin transport and usation genes viuA and viuB and the biosynthetic gene vibF and the other cluster containes genes for the synthesis of DHBA from chorismate (vibABC), a gene for activation of DHBA (vibE), and genes for a periplasmic binding protein-dependent ABC transport system which transports vibriobactin and enterobactin through the periplasm and across the inner membrane. Additionally, gene products of vibD and vibH are required for assembly of vibriobactin from DHBA, threonine and norspermidine (Crosa and Walsh. *Microbiol. and Molec. Biol. Reviews* 66(2): 223-249 (2002)).

The genes pchA, pchB, pchC and pchD (pchDCBA) and pchEF are required to form the siderophore pyochelin and its precursors, salicyclic acid and dihyroaeruginoate (Dha) in *P. aeruginosa*. Three additional genes, pchG, pchH and pchI, are located downstream of pchEF and encode a protein having features similar to the ATP binding cassette transport proteins that have export functions (Drechsel and Jung. *J. Pept. Sci.* 4(3): 147-181 (1998); Crosa and Walsh. *Microbiol. and Molec. Biol. Reviews* 66(2): 223-249 (2002)).

A cluster of the genes mbtA, mbtB, mbtC, mbtD, mbtE, mbtF, mbtG, mbtH, mbtI and mbtJ encode the enzymes for assembly of mycobactin and transport of iron (Crosa and Walsh. *Microbiol. and Molec. Biol. Reviews* 66(2): 223-249 (2002)).

Provided herein are bacteria that over-express siderophores, such as siderophores containing cyclized amino acids. In one embodiment, bacteria can be recombinantly engineered to over-express one or more siderophores, such as agrobactin, parabactin, fluvibactin, vibriobactin, vulnibactin, anguibactin, acinetobactin, mycobactin, exochelin, maduraferrin, pyochelin or yersiniabactin.

In one embodiment, extracellular bacteria, such as *E. coli* Nissle 1917, can be recombinantly engineered to over-express siderophores from, for example, *V. anguillarum* or *P. aeruginosa*. In one non-limiting example, tumor tissues can be specifically infected by intravenously injected *E. coli* Nissle 1917 recombinantly engineered to encode gene products of pchDCBA, thereby increasing production of salicyclic acid, which in turn, causes over-expression of pyochelin siderophores.

Further, bacteria can be, optionally, recombinantly engineered to over-express endogenous iron acquiring mechanisms including, but not limited to, transport of ferric enterobactin into the bacterial cell cytosol requires additional genes, such as the fepB, fepC, fepD, fepE and fepG genes which uptake ferric enterobactin through the periplasm and cytoplasmic membrane, fepA which encodes the outer membrane receptor and fes which encodes intracellular release of iron from enterobactin.

Intracellular bacteria, such as *S. typhimurium*, can be recombinantly engineered to over-express siderophores from, for example, *V. anguillarum* or *P. aeruginosa*. In one non-limiting example, tumor tissues can be specifically infected by intravenously injected *S. typhimurium* recombinantly engineered to encode gene products of pchDCBA, thereby increasing production of salicyclic acid, which in turn, causes over-expression of pyochelin siderophores. Optionally, *S. typhimurium* can also be recombinantly engineered to over-express ferritin-like compounds and/or remove transcriptional iron-repression by Fur. *S. typhimurium*, can be further recombinantly engineered to over-express iron-acquiring mechanisms from other bacteria, such as *Neisseria*, to complement its own iron-acquiring systems.

e. Siderophores Containing Amino Acids of Unusual Structure

Another class of siderophores that contain amino acids having unusual structures. Rhizobactin DM4 belongs to the carboxylate class of siderophores. The amino group of the Rhizobactin DM4 alanine is ethylene-bridged to the amino group of lysine, the side chain of which is acylated with L-malic acid. Other peptide siderophores that have unusual structures include, for example, members the schizokinen/aerobactin family, rhodotorulic acid, and phytosiderophores. The schizokinen/aerobactin family is characterized by citric acid with amino acids or diamines amidated on both carboxy groups. Exemplary members of the schizokinen/aerobactin family include schizokinen, arthrobactin, rhizobactin 1021, acinetoferrin, aerobactin and nannochelin A, nannochelin B, and nannochelin C. Schizokinen, arthrobactin, rhizobactin 1021, acinetoferrin contain amidated diamines, and are thus considered non-proteinaceous (see Non-proteinaceous siderophores below), while aerobactin and nannochelins contain amidated amino acids. Aerobactin contains side-chain amino groups that are N-hydroxylated and acetylated, while nannochelins have cinnamoyl residues in place of the acetylation. Rhodotorulic acid, and a similar siderophore dimerum acid, are characterized by diketopiperazine rings from $N^5$-acylated-$N^5$-hydroxylated ornithine. Phytosiderophores contain α-amino acid substructures, no amide bonds and bonds formed by N-alkylations. Exemplary phytosiderophores include mugineic acid, nicotianamine, avenic acid, and distichonic acid.

In addition to enterobactin, *E. coli* produce the siderophore, aerobactin, which steals iron from human iron carriers such as transferrin. Aerobactin is a hydroxamate-type siderophore is a derivative of citrate and can leach iron from ferric transferrin (Neilands J B. *Microbiol. Sci.* 1(1): 9-14 (1984)). The aerobactin gene of *E. coli* has been shown to be encoded on the pColV plasmid, and four genes (aerA (lysine-$N^6$-oxidase), aerB ($N^6$-hydroxylysine:acetyl CoA $N^6$-acetyltransferase), aerC and aerD) encode the biosynthetic enzymes that assemble the aerobactin siderophore (Drechsel and Jung. *J. Pept. Sci.* 4(3): 147-181 (1998)).

Provided herein are bacteria that over-express siderophores, such as siderophores containing amino acids having unusual structures. In one embodiment, bacteria can be recombinantly engineered to over-express a siderophore, such as aerobactin.

Bacteria (e.g., *E. coli* Nissle 1917) can be recombinantly engineered to over-express iron-acquiring mechanisms of other bacteria such as *P. aeruginosa*. In one non-limiting example, tumor tissues can be specifically infected by intravenously injected *E. coli* Nissle 1917 recombinantly engineered to encode aerA, aerB, aerC and aerD gene products under the control of a high replication promoter, thereby increasing production of aerobactin.

(2) Non-Proteinaceous Siderophores

Non-peptide siderophores include, for example, those that contain diamines instead of amino acids and/or can be N-hydroxylated to form hydroxamates (e.g., ferioxamine, schizokinen, arthrobactin, rhizobactin 1021, acinetoferrin) or serve as carriers for other chelating substructures (e.g., the rhizoferrins, staphyloferrin B) (Drechsel and Jung. *J. Pept. Sci.* 4(3): 147-181 (1998)). Non-proteinaceous siderophores from a variety of bacterial species are presented in Table 4.

Provided herein are bacteria that over-express non-peptide siderophores. In one embodiment, bacteria can be recombinantly engineered to over-express one or more siderophores, such as ferioxamine, schizokinen, arthrobactin, rhizobactin 1021, acinetoferrin, rhizoferrin or staphyloferrin B. Bacteria (e.g., *E. coli* Nissle 1917) can be recombinantly engineered to express or over-express non-peptide siderophores. In one non-limiting example, tumor tissues can be specifically infected by intravenously injected *E. coli* Nissle 1917 recombinantly engineered to express non-peptide siderophores.

(3) Receptor and Transport Proteins

Many bacteria have developed multiple systems regulating the intake and storage of iron. For example, E. coli uses at least five outer membrane proteins that are receptors for siderophores and other iron complexes. *E. coli* also expresses several envelope-associated proteins in addition to the outer membrane receptors, some of which are involved in transport across the outer membrane, transport iron (alone or as a ferric-siderophore complex), across the periplasm and cytoplasmic membrane.

Numerous bacterial proteins are involved in microbial iron uptake and transport, and considerable variation has been found in the uptake schemes used by different bacterial species.

The outer membrane of Gram-negative bacteria constitutes a permeability barrier that protects the cell from exterior hazards, but also complicates the uptake of nutrients, such as iron. Bacteria have evolved such that receptor, transporter and energy-transducing proteins ensure that there is a sufficient supply of iron to the cell (Faraldo-Gomez and Sansom. *Nat. Rev. Mol. Cell. Biol.* 4(2): 105-116 (2003)).

Certain transport proteins also function in siderophore-mediated signaling cascades that start at the cell surface and flow to the cytoplasm to initiate transcription of genes encoding proteins for biosynthesis of transporter proteins and siderophores (Braun and Braun. *FEBS Lett.* 529(1): 78-85 (2002)). Gram-negative pathogenic bacteria employ outer membrane receptors, periplasmic binding proteins and inner membrane associated proteins such as a transporter coupled with an ATP-hydrolyzing protein to extract iron from siderophores. Gram-negative bacteria couple the chemiosmotic gradient of the cytoplasmic membrane with ferric-siderophore transport across the outer membrane. Siderophore uptake into the cytoplasm is mediated by periplasmic binding protein-dependent ABC transporters.

In Gram-negative bacteria, transport of siderophores into the periplasm is often mediated by TonB-dependent receptors. A complex of three membrane-spanning proteins TonB, ExbB and ExbD couples the chemiosmotic potential of the cytoplasmic membrane with siderophore uptake across the outer membrane. Siderophore binding induces distinct local and allosteric transitions that establish the structural basis of signal transduction across the outer membrane and suggest a transport mechanism (Ferguson and Deisenhofer. *Biochim. Biophys. Acta.* 1565(2): 318-332 (2002)).

In one example of the above-described systems, *Escherichia coli* forms sophisticated $Fe^{+3}$-siderophore and heme transport systems across the outer membrane. *E. coli* transports its own siderophores as well as those derived from other bacterial species, and even some fungi, across the outer membrane. Siderophores are transported across the double membrane envelope of *E. coli* via a gating mechanism linking the inner and outer membranes (Neilands J B. *J. Biol. Chem.* 270(45): 26723-26726 (1995); Klebba P E. *Frontiers in Bioscience* 8: s1422-s1436 (2003)). The *E. coli* genome has a number of genes that encode transport systems: FecABCDE transports ferric citrate; FepABCDG transports ferrienterobactin; FhuABCDE transports ferrichrome, ruodoturulate and coprogen; and Cir is a dihydroxybenzylserine outer membrane receptor. Proteins involved in iron up-take by *E. coli* are summarized in Table 5.

TABLE 5

| Siderophore system | Activity |
|---|---|
| FepA | Receptor for endogenous catechol siderophore enterochelin (a cyclic trimester of 2,3-dihydroxy-N-benzoyl serine); and transporter of iron complexes of the enterochelin precursor, dihydroxybenzoic acid and the enterochelin breakdown product, dihyroxybenzoylserine. |
| FhuA | Receptor for ferrichrome (a cyclic trihydroxamate siderophore), produced by many fungal species (e.g., *Ustilago sphaerogena* and *Penicillium* spp.); receptor for hydroxamate siderophores ferricrysin and ferricrosin produced by *Aspergillus* spp.. |
| FhuE | Receptor for linear hydroxamate siderophores coprogen produced by *Penicillium* and *Neurospora* species and rhodotorulic acid produced by *Rhodotorula*, *Sporobolomyces* and *Leucosporidium* species. |
| Cir and Fiu | Susceptible to catechol-substituted cephalosporins and β-lactams for transport of monocatecholic iron complexes; and transporter of iron complexes of the enterochelin precursor, dihydroxybenzoic acid and the enterochelin breakdown product, dihyroxybenzoylserine. |
| FecA | Required for usation of ferric dicitrate as an iron source. |
| FoxB | Receptor for ferrioxamine B (a hydroxamate siderophore synthesized by certain strains of *Streptomyces*) induced in *E. coli* K-12 only in the presence of its cognate ligand. |
| IutA | Outer membrane protein encoded on plasmid ColV-K30 that secretes the hydroxamate siderophore, aerobactin, produced by *K. pneumoniae*. Scavenged by several *E. coli* strains. |

FecI from *Escherichia coli* K-12 is an alternative sigma factor protein of the extracytoplasmic function (ECF) family involved in iron acquisition and hence named the iron-starvation sigmas. FecI causes expression of genes for uptake of ferric citrate and forms part of a signaling system that responds to the presence of ferric citrate. Fec-like signaling systems are present in a wide range of species and many such systems can be present in a single species.

A variety of other bacteria use other proteins to direct transport of siderophores across the bacterial membrane: PupAB of *P. putida* transports pseuobactin; FuyA, FoxA and FcuA are *Yersinia enterocolotica* outer membrane receptors for yersiniabactin, ferrioxamine B and ferrichrome, respectively; and FhuBCDB transports ferrichrome for *Azotobacter vinelandii* and *Bacillus subtilis*. Other outer membrane receptors such as BfeA or BfrABC, can be used by bacteria to transport siderophores and would be known to one skilled in the art (Clarke et al. *Curr. Top. In Med. Chem.* 1: 7-30 (2001); Köster W. *Res. Microbiol.* 152(3-4): 291-301 (2001)).

Two regions of the *Vibrio cholerae* chromosome are involved with vibriobactin-mediated iron uptake: one cluster contains the vibriobactin transport and usation genes viuA and viuB and the other cluster containes genes for a periplasmic binding protein-dependent ABC transport system which transports vibriobactin and enterobactin through the periplasm and across the inner membrane (Crosa and Walsh. *Microbiol. and Molec. Biol. Reviews* 66(2): 223-249 (2002)).

Different periplasmic ligand binding proteins exercise distinct mechanisms for ligand binding and release. For example, E. coli uses the outer membrane siderophore transport proteins FepA and FhuA and an unusual periplasmic siderophore binding protein, FhuD, for ligand transport through the bacterial outer membrane. *Neisseria* species and *Haemophilus influenzae* use the prototypical periplasmic ferric binding protein FbpA for ligand binding and release, which is structurally different from the *E. coli* proteins. *Serratia marcescens* uses the hemophore HasA to extract and use heme. The proteins that provide energy for iron transport at the outer membrane, such as the TonB-ExbB-ExbD system, are structurally very similar across bacterial species, and allows for use of siderophores from different species in the same bacteria (Clarke et al. *Curr. Top. Med. Chem.* 1(1): 7-30 (2001); Poole and McKay. *Front Biosci.* 8: d661-686 (2003)).

One of skill in the art recognizes that any gene of the transporter pathways described herein could be recombinantly engineered such that the encoded protein is overexpressed, thereby facilitating binding of siderophores to the bacterial cell surface, eukaryotic cell surface or tumor cell surface (via recombinant viruses). Increased expression of the receptors increases binding of iron-siderophore complexes to the receptor. Increased iron binding can increase contrast for use in any of the imaging methods provided herein. Additionally, siderophores linked to a therapeutic agent can be used to specifically target bacteria in the tumor environment, thereby specifically delivering the therapeutic agent to the tumor(s). For example, the gene(s) that encode FepA can be placed under the control of a strong promoter on the microbial chromosome, or recombinantly engineered on a plasmid with a high replication rate, resulting in over-expression of FepA.

Tumor tissues can be specifically infected by intravenously injected recombinant extracellular microorganism or cell (e.g., extracellular bacteria or eukaryotic cell), thereby increasing iron-siderophore binding and/or transport by the microorganism or cell in the tumor environment. In one non-limiting example, *E. coli* Nissle 1917 is recombinantly engineered to express FhuE such that the bacteria binds linear hydroxamate siderophores. In another embodiment, bacteria (e.g., *E. coli* Nissle 1917) can be recombinantly engineered to inactivate the genes encoding the siderophore biosynthetic enzymes. Concomitantly with, or subsequent to, administration of the bacteria, iron-loaded siderophores can be systemically administered such that the siderophores specifically hone to the bacteria. The iron-loaded siderophores can further be conjugated to a detectable label and/or therapeutic agent. In one non-limiting example, the linear hydroxamate siderophores that bind FhuE can be administered in a conjugated form, where the conjugated moiety is an imaging moiety or a therapeutic agent. This method can be combined with any of the other methods provided herein.

Tumor tissues can be specifically infected by intravenously injected recombinant intracellular microorganism (e.g., intracellular bacteria), thereby increasing iron-siderophore binding by the receptor expressed on the cell surface of an intracellular bacteria in the tumor cell cytosol. In one non-limiting example, *S. typhimurim* is recombinantly engineered to express FepA on the bacterial cell surface within the tumor cell cytosol. Increased iron binding in the form of iron-siderophore complexes can result in, not only, increased contrast for visualization and detection, but also iron depletion from tumor cells and/or the tumor environment as described herein.

(b) Gram-Positive Bacteria (1) Siderophores

Relatively few siderophores are known to be produced by Gram-positive organisms. *Bacillus subtilis* secretes the siderophore 2,3-dihydroxybenzoyl glycine (DHBG) in response to iron stress, whereas *C. diphtheria* produces a corynebacterial siderophore, and *M. smegmatis* produces the siderophores exochelin and mycobactin (U.S. Pat. No. 5,554,507; Wooldridge and Williams. *FEMS Microbiol. Rev.* 12(4): 325-348 (1993)).

*B. subtilis* DHBG is a catecholic siderophore similar in structure and synthesis to *E. coli* enterobactin, 2,3-dihydroxybenzoyl serine (DHBS). Biosynthesis of DHBG in *B. subtilis* is carried out by a similar set of enzymes, encoded within the dhb operon, dhbA, dhbc, dhbE, dhbB and dhbF. Amino-acid identities between *E. coli* and *B. subtilis* gene product homologs are: EntA and DhbA, 41%; EntC and DhbC, 35%; EntE and DhbE, 48%; EntB and DhbB, 54%; and EntF and DhbF, 29%. The promoter region of the dhb operon contains a consensus binding site of the Fur protein and transcription of the dhb region is iron-repressible similar to *E. coli*. *B. subtilis* can express three Fur homologs, ferric uptake repressor (Fur), zinc uptake repressor (Zur) and peroxide regulon repressor (PerR).

Bacteria (intracellular, extracellular, Gram-positive or Gram-negative) can be recombinantly engineered to express or over-express one or more Gram-positive bacterial siderophores.

Gram positive bacteria (intracellular or extracellular), can be recombinantly engineered to inactivate the genes involved in siderophore biosynthesis. Concomitantly with, or subsequent to, administration of the bacteria, iron-loaded siderophores can be systemically administered such that the siderophores specifically hone to the bacteria. The iron-loaded siderophores can further be conjugated to a detectable and/or therapeutic label.

In one non-limiting example, bacteria, such as *B. subtilis*, can be recombinantly engineered to over-express the genes encoding the enzymes required for DHBG biosynthesis, thereby over-expressing siderophores. Optionally, *B. subtilis* can also be recombinantly engineered to over-express ferritin-like compounds and/or remove transcriptional iron-repression by mutation or deletion of all or part of the fur consensus sequence using any method known in the art or provided herein. In one non-limiting example, tumor tissues can be specifically infected by intravenously injected recombinantly engineered *B. subtilis* causing increased production of DHBG, thereby dis-regulating iron hemostasis in the tumor environment.

Alternatively, bacteria such as *B. subtilis* can be recombinantly engineered to express or over-express siderophores, such as corynebacterial siderophore. Tumor tissues can be specifically infected by intravenously injected recombinantly engineered *B. subtilis*, thereby secreting the corynebacterial siderophore, increasing iron acquisition and dis-regulating iron hemostasis in the tumor environment.

In another embodiment, a Gram-negative bacteria such as *E. coli* Nissle 1917 can be recombinantly engineered to over-express the genes encoding DHBG biosynthetic enzymes and/or the receptor for DHBG. Optionally, *E. coli* Nissle 1917 also can be recombinantly engineered to over-express ferritin-like compounds and/or remove transcriptional iron-repression. Tumor tissues can be specifically infected by intravenously injected recombinantly engineered *E. coli* Nissle 1917. Increased iron binding in the form of iron-DHBG complexes can result in, not only, increased contrast for visualization and detection, but also iron depletion from tumor cells and/or the tumor environment. Iron depletion from tumor cells and/or the tumor environment removes a vital nutrient from the tumor cells, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Alternatively, DHBG can be administered in a conjugated form, where the conjugated moiety is an imaging moiety or a therapeutic agent. In some cases, the imaging moiety and therapeutic agent are the same, e.g., a radionuclide. This method can be combined with any of the other methods provided herein.

In another embodiment, an intracellular bacteria, such as *S. typhimurium* can be recombinantly engineered to over-express the gene encoding DHBG, a precursor thereof, and the receptor for DHBG. Optionally, *S. typhimurium* also can be recombinantly engineered to over-express ferritin-like compounds and/or remove transcriptional iron-repression. Tumor cells can be specifically infected by intravenously injected recombinantly engineered *S. typhimurium*. In the tumor cell cytosol, DHBG would bind internalized iron and transport it to the DHBG receptor. Increased iron binding in the form of iron-DHBG complexes can result in, not only, increased contrast for visualization and detection, but also iron depletion from tumor cells and/or the tumor environment. Iron depletion from the tumor environment removes a vital nutrient from the tumor cells, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Alternatively, DHBG can be administered in a conjugated form, where the conjugated moiety is an imaging moiety or a therapeutic agent. In some cases, the imaging moiety and therapeutic agent are the same, e.g., a radionuclide. This method can be combined with any of the other methods provided herein.

(2) Receptor and Transport Proteins

The receptor proteins that are anchored in the plasma membrane of Gram-positive bacteria deliver siderophores to ATP-binding-cassette (ABC) importers, which promote their translocation across the membrane. ABC importers require energy from the hydrolysis of ATP to transport translocation across the cell membrane in bacteria such as *B. subtilis*, and *C. diphtheria* (Faraldo-Gomez and Sansom. *Mol. Cell. Biol.* 4: 1-5-116 (2003)). In *Staphylococcus epidermidis* and *Staphylococcus aureus*, a number of cell wall- and cytoplasmic membrane-associated lipoproteins are induced in response to iron starvation. The *S. epidermidis* sitABC operon has been sequenced as has been shown to encode an ABC transporter protein that transports ferric-siderophores into the cell cytosol (Hill et al. *Infect Immun*. 66(9): 4123-4129 (1998)).

Bacteria (intracellular or extracellular) can be recombinantly engineered to over-express the sitABC operon encoding the ABC transporter that transports ferric-siderophores into the cell cytosol. For example, extracellular bacteria, such as *B. subtilis*, can be recombinantly engineered to over-express the sitABC operon encoding the ABC transporter. In one non-limiting example, tumor tissues can be specifically infected by intravenously injecting such recombinantly engineered *B. subtilis*, thereby facilitating intake of siderophores in extracellular spaces and causing dis-regulation of iron hemostasis in the tumor environment.

In another example, intracellular bacteria, such as *S. typhimurium*, can be recombinantly engineered to over-express the sitABC operon encoding the ABC transporter. In one non-limiting example, tumor cells can be specifically infected by intravenously injecting such recombinantly engineered *S. typhimurium*, thereby facilitating intake of siderophores from the tumor cell cytosol and causing dis-regulation of iron hemostasis in the tumor cells.

Increased iron acquisition by the bacteria can result in, not only, increased contrast for visualization and detection, but also iron depletion from tumor cells and/or the tumor environment. Iron depletion from tumor cells and/or the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells). This method can be combined with any of the other methods provided herein.

(c) Viruses

Viruses (such as Vaccinia virus) also can be used to increase iron accumulation by tumor cells. For example, the tumor tissues can be specifically infected by intravenously injected engineered Vaccinia virus carrying, for example, a siderophore receptor gene and/or genes encoding siderophore biosynthetic enzymes (also encoding signal peptides for cell surface expression and secretion). Expression of the siderophore receptor on the tumor cell surface will mark these cells for targeting by siderophores. Tumor cell binding and/or internalization of the siderophore-metal (e.g., iron, gadolinium or gallium) pair increases iron accumulation. In addition, internalization of the siderophore-metal (e.g., iron, gadolinium or gallium) pair can result in accumulation of iron to a toxic level, thereby causing tumor cell lysis, and/or accumulation of iron to a level that can be detected using any of the imaging methods provided herein. This method can be combined with any of the other methods provided herein.

Tumor tissues can be specifically infected by intravenously injected recombinant intracellular microorganism (e.g., virus), thereby increasing iron-siderophore binding by the receptor expressed on the tumor cell surface. In one non-limiting example, Vaccinia virus can be recombinantly engineered to express FepA (via a signal peptide) on the tumor cell surface. Increased iron binding in the form of iron-siderophore complexes can result in, not only, increased contrast for visualization and detection, but also depletion of tumor cells of iron in a usable form. Iron depletion from the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Alternatively, the siderophore that binds to the recombinantly engineered receptor can be administered in a conjugated form, where the conjugated moiety is an imaging moiety or a therapeutic agent. In some cases, the imaging moiety and therapeutic agent are the same, e.g., a radionuclide. This method can be combined with any of the other methods provided herein.

(d) Eukaryotic Cells

Eukaryotic cells also can be used to deplete iron from the tumor cell environment. For example, the tumor tissues can be specifically infected by intravenously injected engineered eukaryotic cells (e.g., human fibrosarcoma cells) carrying, for example, a siderophore receptor gene and/or genes encoding siderophore biosynthetic enzymes (also encoding signal peptides for cell surface expression and secretion). Expression of the siderophore receptor on the eukaryotic cell surface will mark these cells for targeting by siderophores. Internalization of the siderophore-metal (e.g., iron, gadolinium or gallium) pair increases iron accumulation. In addition, internalization of the siderophore-metal (e.g., iron, gadolinium or gallium) pair can result depletion of iron from the tumor environment, thereby killing tumor cells, and/or accumulation of iron to a level that can be detected using any of the imaging methods provided herein. This method can be combined with any of the other methods provided herein.

One of skill in the art would recognize that any gene of the transporter pathways described herein could be recombinantly engineered such that the encoded protein is overexpressed, thereby facilitating binding of siderophores to a eukaryotic cell surface. Increased expression of the receptors increases binding of iron-siderophore complexes to the receptor, and increased iron binding can increase contract for use in any of the imaging methods provided herein. Additionally, siderophores linked to a therapeutic agent can be used to specifically target eukaryotic cells in the tumor environment, thereby specifically delivering the therapeutic agent to the tumor(s).

In one non-limiting example, tumor tissues can be injected with recombinant eukaryotic cells, thereby increasing iron-siderophore binding and/or iron transport by the recombinant cells in the tumor environment. A human fibrosarcoma cell line is recombinantly engineered, for example to express FepA such that the cells binds enterochelin. Increased iron binding in the form of iron-enterochelin complexes can result in, not only, increased contrast for visualization and detection, but also iron depletion from the tumor environment as described herein. Iron depletion from the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Alternatively, enterochelin can be administered in a conjugated form, where the conjugated moiety is an imaging moiety or a therapeutic agent. In some cases, the imaging moiety and therapeutic agent are the same, e.g., a radionuclide. This method can be combined with any of the other methods provided herein.

(e) Multiple Siderophore and Uptake Systems

The majority of bacteria, especially gram negative bacteria, produce more than one siderophore and have more than one transport and storage systems to meet the basic demand for iron. For example, fluorescent pseudomonads primarily produce complex peptidic siderophores called pyoverdines or pseudobactins, but they also produce a variety of other siderophores, such as, for example, pseudobactins, catecholate siderophores, lipopeptidic siderophores, salicyclic acid, pseudomonine, pyochelin, micacodicin, hydrogen cyanide, hydroxamate siderophores, ferrorosamine, and derivatives thereof. Siderophores that are related to pyoverdins include, for example, 5,6-dihydrophyoverdins, ferribactins and *Azotobacter* and *Azomonas* siderophores.

Bacteria also compete with each other and the environment for iron. In addition to making multiple siderophores, transport and storage systems, most bacteria are capable of capturing heterologous siderophores (also termed "xenosiderophores") from other bacterial species. For example, *P. aeruginosa* can use enterobactin (enterochelin) produced by *E. coli* as well as its biosynthetic precursors (e.g., 2,3-dihydrobenzoic acid and N-(2,3-dihydroxybenzoyl)-L-serine), and desferri-ferrioxamine B (desferal) from *Streptomyces* species (Budzikiewicz et al. *Fortschr. Chem. Org. Naturst.* 87: 81-237 (2004)). Activation of the heterologous transport systems is not only regulated by iron availability but also requires the presence of their cognate ferric-siderophores. The ability to use a variety of heterologous siderophores reflects both the importance of iron for growth and survival and the need to compete with other microorganisms in the environments that they inhabit (Venturi et al. *Mol. Microbiol.* 17(4): 603-610 (1995); Schalk et al. *Biochem. Soc. Trans.* 30(4): 702-705 (2002)).

For the methods provided herein, bacteria can be recombinantly engineered to over-express more than one endogenous siderophore, more than endogenous transport receptor, more than one storage proteins or a combination thereof. Alternatively, or in addition, bacteria also can be recombinantly engineered to express one or more heterologous siderophores, transport receptor, storage proteins or a combination thereof. Bacteria used herein can be intracellular bacteria or extracellular bacteria.

In one non-limiting embodiment, *E. coli* Nissle 1917 is recombinantly engineered to over-express *E. coli* enterobactin and the TonB receptor. In one example, *E. coli* Nissle 1917 is recombinantly engineered to over-express *E. coli* enterobactin and *P. aeruginosa* pyoverdin. In yet another example, *E. coli* Nissle 1917 is recombinantly engineered to over-express *P. aeruginosa* pyoverdin and the TbpA-TbpB receptor of *Neisseria*. Tumor tissues can be specifically infected by intravenously injected *E. coli* Nissle 1917 recombinantly engineered as described above, thereby increasing iron acquisition by the bacteria in the tumor environment. Increased metal acquisition in the form of siderophore-metal (e.g., iron, gadolinium or gallium) can result in, not only, increased contrast for visualization and detection, but also iron depletion from the tumor environment. Iron depletion from the tumor environment removes a vital nutrient from the tumors, thereby dis-regulating iron hemostasis in the tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells). This method can be combined with any of the other methods provided herein.

For the methods provided herein, eukaryotic cells can be recombinantly engineered to express or over-express one or more siderophore(s), one or more exogenous siderophore membrane receptor(s) or a combination thereof. For example, human fibrosarcoma cells can be recombinantly engineered to express or over-express the FepA receptor and the siderophore, enterochelin. Alternatively, or in addition, eukaryotic cells also can be recombinantly engineered to express one or more heterologous storage protein(s), or a combination thereof as described elsewhere herein. For example, the human fibrosarcoma cells can be recombinantly engineered to express or over-express a bacterioferritin, bacterial ferritin, dodecameric ferritin, an H chain, an L chain or a combination thereof. Tumor tissues can be specifically infected by intravenously injected human fibrosarcoma cells recombinantly engineered as described above, thereby increasing iron binding/acquisition by the human fibrosarcoma cells in the tumor environment. Increased metal acquisition in the form of siderophore-metal (e.g., iron, gadolinium or gallium) can result in, not only, increased contrast for visualization and detection, but also iron depletion from the tumor environment. Iron depletion from the tumor environment removes a vital nutrient from the tumors, thereby dis-regulating iron hemostasis in the tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Eukaryotic cell internalization of iron in the tumor environment allows the internalization of iron alone, a supplemental imaging moiety or a therapeutic agent (which in turn delivers cytotoxicity specifically to the tumor cells). This method can be combined with any of the other methods provided herein.

For the methods provided herein, viruses can be recombinantly engineered to express or express or over-express one or more siderophore(s), one or more exogenous siderophore membrane receptor(s) or a combination thereof on the surface of tumor cells using any of the methods provided herein. For example, a vaccinia virus can be recombinantly engineered to express or over-express the FepA receptor and the siderophore, enterochelin using the appropriate signal peptides such that, when infected, the tumor cell expresses the receptor on the tumor cell surface and secretes the siderophore. Expression of the receptor on the tumor cell surface marks the cells for siderophore-metal binding. Alternatively, or in addition, viruses also can be recombinantly engineered to express one or more heterologous storage protein(s), as described elsewhere herein, which increase iron storage in the tumor cells. For example, a vaccinia virus can be recombinantly engineered to express or over-express a bacterioferritin, bacterial ferritin, dodecameric ferritin, an H chain, an L chain or a combination thereof. Tumor tissues can be specifically infected by intravenously injected vaccinia virus recombinantly engineered as described above, thereby increasing iron binding/acquisition by the tumor cells.

Increased metal binding/acquisition in the form of siderophore-metal (e.g., iron, gadolinium or gallium) can result in, not only, increased contrast for visualization and detection, but also depletion of tumor cells of iron in a usable form. Iron depletion from the tumor environment removes a vital nutrient from the tumors, thereby dis-regulating iron hemostasis in the tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Tumor cell binding and/or internalization of iron in the tumor environment allows the internalization of iron alone, a supplemental imaging moiety or a therapeutic agent (which in turn delivers cytotoxicity specifically to the tumor cells). This method can be combined with any of the other methods provided herein.

(f) Acquisition of Metals Other than Iron

In addition to binding iron, siderophores, such as pyoverdins, also are able to form complexes with other metals, such as gallium, gadolinium and chromium (Cornelis and Matthijs. *Environ. Microbiol.* 4(12): 787-798 (2002; Neilands J B. *Microbiol. Sci.* 1(1): 9-14 (1984); Cornelis and Matthijs. *Environ. Microbiol.* 4(12): 787-798 (2002)).

In addition to increased internal contrast agent via iron acquisition, a subject can be systemically injected labeled gallium, such as $^{67}$Ga, which will be bound by the siderophore, resulting in increased contrast agent at the site of the tumor. The tumors can then be visualized by any of the methods provided herein. This method can be used for any of the microorganisms and cells provided herein and combined with any other method described herein.

In one non-limiting example, tumor tissues can be specifically infected by intravenously injected bacteria (such as *E. coli* Nissle 1917) recombinantly engineered to express or over-express pyoverdin, thereby supplementing the bacteria's own iron uptake and storage and increasing iron acquisition by the bacteria in the tumor environment. The subject can be intravenously injected with labeled gallium, which will be bound by pyoverdin, resulting in increased contrast agent at the site of the tumor. Administration of labeled gallium can be concurrent with, prior to, or subsequent to, administration of the recombinant bacteria. The tumors can then be visualized by any of the methods provided herein. This method can be combined with any other method described herein.

In one non-limiting example, tumor tissues can be specifically infected by intravenously injected viruses (such as Vaccinia virus) recombinantly engineered to express or over-express pyoverdin by the tumor cells or the pyoverdin receptor (also encoding single peptides for cell surface expression and secretion) on the surface of the tumor cells, thereby increasing iron acquisition by the tumor cells. The subject can be intravenously injected with labeled gallium, which will be bound by pyoverdin, resulting in increased contrast agent at the site of the tumor. Administration of labeled gallium can be concurrent with, prior to, or subsequent to, administration of the recombinant Vaccinia virus.

The tumors can then be visualized by any of the methods provided herein. This method can be combined with any other method described herein.

In one non-limiting example, tumor tissues can be specifically infected by intravenously injected eukaryotic cells recombinantly engineered to express or over-express pyoverdin and/or its receptor (also encoding single peptides for cell surface expression and secretion), thereby supplementing the cells own iron uptake and storage and increasing iron acquisition by the eukaryotic cells in the tumor environment. The subject can be intravenously injected with labeled gallium, which will be bound by pyoverdin, resulting in increased contrast agent at the site of the tumor. Administration of labeled gallium can be concurrent with, prior to, or subsequent to, administration of the recombinant eukaryotic cells. The tumors can then be visualized by any of the methods provided herein.

These methods can be combined with any other method described herein. Additionally, any of the microorganisms and cells provided herein can be used using methods described herein and known in the art to increase metal acquisition for visualization, therapy or a combination thereof.

ii. Other (a) Prokaryotic Cells (1) Acquisition of Exogenous Siderophores

The success of human pathogens such as *Neisseria* species, which do not express their own siderophores can be attributed in part to the efficient usation of multiple host iron (Fe) sources, allowing replication on mucosal surfaces, in the bloodstream, and intracellularly.

While pathogenic *Neisseria* species do not excrete any detectable siderophores themselves, they do express receptors that recognize siderophores made by other microbes. *Neisseria* species use outer membrane receptors to acquire iron. For example, outer membrane receptors that can transport exogenous siderophores in *Neisseria* include, for example, FrpB, HmbR, FetA, TdfF, TdfG and TdfH. Several proteins in *Neisseria* are involved in transporting iron into the cell cytosol, such as the energy transducing components, TonB which transfers energy to the outer membrane receptors, and ExbB and ExbD, which stabilize TonB. Intracellularly, FbpA, FbpB, FbpC, FetB and HemO bind ferrous iron or siderophores, whereas BfrA and BfrB store iron and protect the bacteria from oxidative stress (Rohde and Dyer. *Front Biosci.* 8:d1186-218 (2003); Cornelissen C N. *Frontiers in Bioscience* 8: d836-d847 (2003); Clarke et al. *Curr. Top. Med. Chem.* 1 (1): 7-30 (2001)).

Bacteria, such as *Neisseria*, can be used to label the tumor with contrast agent. For example, tumor tissues can be specifically infected by intravenously injected *N. meningitis* which will acquire iron through a variety of mechanisms as described herein, thereby producing a contrast agent that can be visualized using the methods described herein. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells). This method can be combined with any of the other methods provided herein.

Bacteria, such as *Neisseria*, can also be recombinantly engineered to over-express iron-acquiring mechanisms. TbpA-TbpB outer membrane receptor proteins are only one of many examples of ligand-receptor pairs that can be used. In one non-limiting example, tumor tissues can be specifically infected by intravenously injected *N. meningitis* recombinantly engineered to over-express TbpA-TbpB outer membrane receptor proteins. Increased iron acquisition can result in, not only, increased contrast for visualization and detection, but also iron depletion from the tumor environment. Iron depletion from the tumor environment removes a vital nutrient from the tumors, thereby dis-regulating iron hemostasis and delaying tumor progression and/or killing the tumor. This method can be combined with any of the other methods provided herein.

Bacteria other than *Neisseria* (e.g., *E. coli* Nissle 1917) can be recombinantly engineered to over-express *Neisseria* iron-acquiring mechanisms to complement their own iron-acquiring systems. Increased iron acquisition can result in, not only, increased contrast for visualization and detection, but also iron depletion from the tumor environment as described herein. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells). These methods can be combined with any of the other methods provided herein.

(2) Acquisition from Host Carriers

In the absence of siderophores, *Neisseria* spp. are capable of iron acquisition from host carriers via expression of cell surface receptors. In response to conditions of low iron, bacteria have developed capabilities for scavenging iron from host carriers/sources such as lactoferrin, transferrin, hemoglobin and heme from host environments (Rohde and Dyer. *Front Biosci.* 8:d1186-218 (2003); Cornelissen C N. *Frontiers in Bioscience* 8: d836-d847 (2003)).

Exemplary bacteria including, but not limited to, *Haemophilus influenzae, Yersinia enterocolitica, Actinobacillus pleuropneumoniae, Helicobacter pylori, Yersinia pestis, N. memingitidis, N. gonorrhoeae, E. coli O157, Bacteroides* species, *Pasteurellaceae* species, *Moraxellaceae* species and *Serratia marcescens* have developed outer membrane receptors and/or ABC transport systems for removing iron from lactoferrin, transferrin, hemoglobin and heme from host environments (Clarke et al. *Curr. Top. Med. Chem.* 1:7-30 (2001)).

Bacteria, such as *Neisseria* species, for example, express transferrin (Tf) and lactoferrin (Lf) receptors (TfR and LfR, respectively). The transferrin and lactoferrin receptor proteins are located in the outer membrane and are induced by iron starvation. Unlike other TonB-dependent receptors where ferric-siderophores are wholly internalized, the bacterial transferrin receptor must remove iron from transferrin at the cell surface (Cornelissen C N. *Front Biosci.* 8: d836-847 (2003)). Iron is removed from host carrier at the bacterial cell surface and transported across the cell membrane for storage in ferritin molecules. The receptors are composed of two dissimilar proteins: Tbp1 and Tbp2 (also designated TbpA and TbpA, respectively) for the transferrin receptor and Lbp1 and Lbp2 (also designated LbpA and LbpA, respectively) for lactoferrin. Tbp2 and Lbp2 are homologous, but not related to outer membrane siderophore receptors and Tbp1 and Lbp1 have an affinity for transferrin and lactoferrin, respectively. Uptake of $Fe^{+3}$ scavenged from transferrin and lactoferrin is TonB-ExB-ExbD- and Pmf-dependent. Iron is then transported across the periplasm and cytosolic membrane by a periplasmic binding protein ABC permease system. Fbp has been shown to be the periplasmic binding protein for *N. gonorrhoeae* and *H. influenzae*.

A representative sampling of receptors that acquire iron from host environments is provided in Table 6.

In a further embodiment, *N. meningitidis* can be transformed with one or more high copy plasmids having genes encoding one or more ferritin-like molecules that are endogenous and/or exogenous to the bacteria. For example, *N.*

TABLE 6

Receptor and transport proteins for acquisition of host iron

| Iron Source | Bacteria | Protein | Function |
|---|---|---|---|
| Transferrin, lactoferrin | *H. influenzae* | LbpAB | Lf OM receptor |
| | | TbpAB | Tf OM receptor |
| | | HitABC | $Fe^{+3}$ ABC transport system |
| | *Neisseria* spp. | LbpAB | Lf OM receptor |
| | | TbpAB | Tf OM receptor |
| | | FbpABC | $Fe^{+3}$ ABC transport system |
| Lactoferrin | *Y. enterocolitica* | Yfu | $Fe^{+3}$ ABC transport system |
| | *A. pleuropneumoniae* | Afu | $Fe^{+3}$ ABC transport system |
| | *H. pylori* | | ABC transport system |
| Heme | *E. coli* O157 | ChuA | Heme OM receptor |
| | *Neisseria* spp. | HmgR | Heme/Hb OM receptor |
| | | HpuAB | Heme/Hb OM receptor |
| | *S. marcescens* | SfuABC | $Fe^{+3}$ ABC transport system |
| | *S. dysenteriae* | ShuA | Heme OM receptor |
| | *V. cholerae* | | |
| | *Y. enterocolitica* | HemPRSTUV | |
| Hemoglobin | *N. gonorrhoeae* | HpuAB | Heme/Hb OM receptor |
| | *N. meningitidis* | HmbR | Heme/Hb OM receptor |
| | *P. aeruginosa* | PhuR | Heme/Hb OM receptor |
| | | PhuSTUVW | Heme ABC transport system |
| | | HasRADEF | Heme receptor, hemophore, ABC transporter for HasA export |
| Reduced iron | *E. coli* | FeoAB | $Fe^{+2}$ transport |
| | *P. aeruginosa* | | |
| | *Streptococcus* spp. | | |

Data from Clarke et al. (Curr. Top. Med. Chem. 1: 7-30 (2001)) and Andrews et al. (FEMS Microbiol. Rev. 27(2-3): 215-237 (2003)).
OM: outer membrane.

Some extracellular Gram-negative bacteria, including, but not limited to *Bacteroides fragilis*, have an absolute requirement for exogenous supply of heme, or its precursor, protoporphyrin IX. Bacteria use hemolysins and proteases to release heme and hemoglobin from red blood cells. The heme and hemoglobin can then directly transported by bacteria. Gram-negative bacteria use outer membrane receptors to bind heme, hemoglobin or heme complexes, and transport the heme group across the outer membrane in a TonB-ExB-ExbD-dependent similar to iron acquired from lactoferrin and transferrin. Transportation of heme across the cytosolic membrane requires an ABC permease, but does not require a periplasmic binding protein. Once in the cytoplasm, the heme is degraded to release the iron, which is then stored in ferritin molecules (Andrews et al. *FEMS Microbiol. Rev.* 27: 215-237 (2003); Genco and Dixon *Mol. Microbiol.* 39: 1-11 (2001)).

Bacteria, such as *N. gonorrhoeae*, for example, can be transformed with one or more high copy plasmid(s) recombinantly engineered with the genes encoding an outer membrane protein that can recognize iron bound to a host carrier. In one embodiment, *N. gonorrhoeae* is transformed with one or more high copy plasmid(s) having the genes encoding Tbp1 and Tbp1. In another embodiment, a mixture of bacterial species from families such as, for example, Neisseriaceae, Pasteurellaceae and Moraxellaceae, can be transformed as described herein.

In a further embodiment, *N. gonorrhoeae* can be recombinantly engineered to express or over-express one or more siderophores (endogenous or exogenous) and/or one or more outer membrane proteins or transport proteins as described elsewhere herein to increase iron acquisition and transport of iron.

*meningitidis* can be transformed with high copy plasmids having genes encoding a bacterioferritin, a bacterial ferritin, a dodecameric ferritin and/or high copy plasmids having genes encoding. the eukaryotic H chain, L chain, or H and L chains.

Tumor tissues can be specifically infected by intravenously injected *N. gonorrhoeae* recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis and delaying tumor progression and/or killing the tumor.

Alternatively, bacteria (other than *Neisseria*) can be recombinantly engineered to over-express iron-acquiring mechanisms from other bacteria, such as *Neisseria*, to complement their own iron-acquiring systems. Increased iron acquisition can result in, not only, increased contrast for visualization and detection, but also iron depletion from the tumor environment as described herein.

For example, *E. coli* strains can be recombinantly engineered to express one or more proteins that scavenge iron from host proteins. In one non-limiting embodiment, tumor tissues can be specifically infected by intravenously injected *E. coli* Nissle 1917 recombinantly engineered to express or over-express ChuA heme outer membrane receptor (SEQ ID NO: 71), the LbpAB lactoferrin outer membrane receptor proteins, the Yfu $Fe^{+3}$ ABC transport system, or a combination thereof. Increased iron acquisition can result in, not only, increased contrast for visualization and detection, but also iron depletion from the tumor environment. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells).

Alternatively, any of the bacteria provided herein can be recombinantly engineered to express or over-express eukaryotic iron-acquiring mechanisms as described below. For example, bacteria can be recombinantly engineered to express or overexpress the gene(s) encoding the lactoferrin receptor. Exemplary bacteria including, but not limited to, *E. coli* Nissle 1917 recombinantly engineered to express or overexpress the gene(s) encoding the lactoferrin receptor. Tumor tissues can be specifically infected by intravenously injected such recombinant *E. coli* Nissle 1917 bacteria. Increased iron acquisition can result in, not only, increased contrast for visualization and detection, but also iron depletion from tumor cells and/or the tumor environment. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent.

This method can be combined with any other method described herein, such as systemically injecting labeled gallium, such as $^{67}$Ga, for tumors infected with bacteria expressing or over-expressing pyoverdin, resulting in increased contrast agent at the site of the tumor. These methods can be combined with any of the other methods provided herein.

(b) Eukaryotic Cells

The processes of iron uptake and distribution are highly regulated in mammalian cells. Expression of the transferrin and lactoferrin receptors are increased when cells are iron-depleted, while expression of the iron sequestration protein, ferritin, is increased in cells that are iron-replete. Regulation of expression of proteins of iron uptake (transferrin and lactoferrin receptors) and iron sequestration (ferritin) ensures that levels of reactive free iron are not toxic in cells (Rouault and Klausner. *EXS.* 77: 183-197 (1996)).

Solubilization of ferric iron in mammalian cells occurs through binding of iron to the iron carrier proteins transferrin and lactoferrin. Each transferrin can bind two ferric ions and transport it through circulation, where it eventually binds to a transferrin receptor. Transferrin receptors are 90 kDa homodimers present on plasma membranes of eukaryotic cells. When bound with ligand, the receptor-ligand complex is internalized and iron released to the cell cytosol, where it is used in cellular processes or stored in ferritins (Rouault and Klausner. *Curr. Top. Cell. Reg.* 35: 1-19 (1997)). 9L gliosarcoma cells have been transfected with engineered transferrin receptor that lacked the iron-regulating region and mRNA destabilization motifs in the 3' untranslated region resulting in high level expression of constitutive transferrin receptor at the cell surface (Weissleder et al. *Nature Medicine* 6(3): 351-354 (2000)).

Lactoferrin receptors (LfRs) have been identified on various types of mammalian cells such as lymphocytes, hepatocytes and enterocytes. The entire coding region of the human intestinal LfR (HLFR) has been cloned by polymerase chain reaction (PCR), a recombinant HLFR (rHLfR) was expressed in a baculovirus system, and retained the capacity to bind HLf (Suzuki and Lonnerdal. *Biochem Cell Biol.* 80(1):75-80 (2002)).

Encompassed herein are diagnostic and therapeutic methods using eukaryotic cells recombinantly engineered to over-express receptors for host proteins that carry iron, such as transferrin, lactoferrin and heme. Eukaryotic cells include cells from multicellular eukaryotes, including mammals such as primates, where exemplary cells are human cells. Typically the cells are isolated cells. For example, eukaryotic cells can be fibrosarcoma cells or stem cells.

Eukaryotic cells can be recombinantly engineered to express or over-express genes encoding the Tbp1 and Tbp2 proteins, the Lbp1 and Lbp2 proteins, or a combination thereof. Optionally, eukaryotic cells can be further recombinantly engineered with any of the other receptors described herein. Tumor tissues can be specifically infected by intravenously injected eukaryotic cells recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis and delaying tumor progression and/or killing the tumor.

This method can be combined with any other method described herein, such as systemically injecting labeled gallium, such as $^{67}$Ga, for tumors infected with bacteria expressing or over-expressing pyoverdin, resulting in increased contrast agent at the site of the tumor. These methods can be combined with any of the other methods provided herein.

(c) Viruses

Viruses (such as Vaccinia virus) can also be used to label the tumor cell surface with receptor proteins. For example, the tumor tissues can be specifically infected by intravenously injected engineered Vaccinia virus carrying, e.g., a transferrin receptor gene (also encoding a signal peptide for cell surface expression). Expression of the transferrin receptor on the tumor cell surface will mark these cells for targeting by diagnostic or therapeutic-ligand fusion proteins. In this case, the ligand is the transferrin protein, and the therapeutic protein could be a *Pseudomonas* exotoxin (or any other cytotoxic therapeutic proteins) and the diagnostic protein can be iron, gold, gadolinium or gallium. Tumor cell internalization of the transferrin/transferrin receptor pair allows the internalization of the therapeutic protein, which in turn delivers the diagnostic or therapeutic protein specifically to the tumor cells. The transferrin-transferrin receptor pair is only one of many examples of ligand-receptor pairs that can be used. In addition, other ligand-receptor pairs as described above can be used in any of methods provided herein. These methods can be combined with any of the other methods provided herein. Exemplary viruses provided herein that express a transferrin receptor include GLV-1h22 and GLV-1h82.

In another embodiment, a virus (such as Vaccinia virus) can be recombinantly engineered to express eukaryotic or prokaryotic iron-acquiring mechanisms. For example, bacteria can be transformed with high copy plasmids having genes encoding the Tbp1 and Tbp2 proteins, the Lbp1 and Lbp2 proteins, or a combination thereof. Tumor tissues can be specifically infected by intravenously injected viruses recombinantly engineered as described herein. Increased iron acquisition can result in, not only, increased contrast for visualization and detection, but also iron depletion from the tumor environment. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide.

Bacterial cell internalization of iron in the tumor environment allows the internalization of iron alone, a supplemental imaging moiety or a therapeutic agent (which in turn delivers cytotoxicity specifically to the tumor cells). These methods 15, can be combined with any of the other methods provided herein.

c. Iron Regulation

Nearly every microorganism or cell needs iron for growth and metabolism. The ability of pathogens to obtain iron from transferring, hemoglobin, etc., is important for survival. Iron bound to lactoferrin and transferrin is much less accessible than soluble iron. Therefore, pathogens use specific mechanisms for iron acquisition from their host. Iron storage and use is tightly regulated in cells to ensure that iron supplies are adequate and non-toxic.

i. Prokaryotic Cells

Iron homeostasis in prokaryotic cells is regulated at the level of the genome by proteins that are sensitive to iron levels. Many siderophores and ferritins are regulated by the repressor Fur (Rouault and Klausner. *Curr. Top. Cell. Reg.* 35: 1-19 (1997); Braun *Front Biosci* 1(8s): 1409-1421 (2003))

(a) Gram-Negative Bacteria

Iron homeostasis in Gram-negative bacteria is essentially regulated at the level of the genome by the Fur protein. When iron is in short supply the uptake and assimilation pathways are de-repressed and siderophores are synthesized together with the outer, inner (plasma) membrane, periplasmic and cytosolic components necessary for the uptake of ferri-siderophores. Siderophores bring iron to the cell to be internalized and stored in ferritin-like molecules.

The product of the fur gene (i.e., Fur) exists as an intracellular iron regulator. During states of high iron levels, Fur complexes with ferrous irons and Fur-$Fe^{+2}$ complexes transcriptionally repress iron-regulated promoters of genes that act to code for siderophores or membrane proteins that uptake iron-siderophore complexes. Fur-$Fe^{+2}$ complexes also activate genes for bacterial ferritin and/or bacterioferritin synthesis, thereby causing removal of excess ferrous ($Fe^{+3}$) ions from the cytosol. Thus, there is a feedback loop that is dependent upon iron levels (J L Smith. *Crit. Rev. in Microbiol.* 30: 173-185 (2004), Wandersman and Delepelaire. *Annu. Rev. Microbiol.* 58: 611-647 (2004)). When iron is not limiting, the $Fe^{+2}$-Fur complex acts as a transcriptional repressor, and shuts down the synthesis of all the components of iron assimilation (Crichton and Ward. *Analyst.* 120(3):693-697 (1995)).

The DNA-binding regions of the Fur protein have been identified in *E. coli* as a 19 base pair consensus sequence (5'-TGATAATGATAATCATTATCA-3'; SEQ ID NO: 46; Baichoo and Helmann, *J Bacteriol.*, 184(21):5826-32 (2002)) that is found in the promoter region of genes that are negatively and positively regulated by iron. Similar sequences have been found in the promoter genes of iron-regulated genes from organisms other than *E. coli* (Crichton and Ward. *Analyst* 120: 693-697 (1995)).

Although fur mutants have been shown to have very low iron contents (2.5-fold less iron than Fur+ strains) despite constitutive expression of the iron acquisition systems (Abdul-Tehrani et al. *J. Bacteriol.* 181(5): 1415-1428 (1999)), it is possible to increase the iron storage-capacity of bacteria, in the absence of Fur, by over-expressing ferritin-like proteins. For example, provision of the *H. pylori* pfr gene on a multi-copy plasmid resulted in reversal of the Fur-mediated repression of the fhuF gene in *E. coli* (Bereswill et al. *Microbiology.* 144 (Pt 9): 2505-2516 (1998)).

Any of the Gram-negative bacteria provided herein can be recombinantly engineered to remove transcriptional iron-repression using methods known in the art. In one non-limiting example, the fur gene can be inactivated by replacing all or some of the fur consensus sequence with disrupted derivatives containing antibiotic resistance cassettes. In another example, the fur gene can be inactivated by creating disrupted derivatives containing antibiotic resistance cassettes in place of internal segments of the corresponding coding regions. These methods can be included with any of the other methods provided herein to recombinantly engineer Gram-negative bacteria to express one or more of siderophores, outer membrane proteins, transport proteins, ferritins, or a combination thereof, thereby increasing the ability of the Gram-negative bacteria to acquire iron.

For example, Gram-negative bacteria can be transformed with multiple high copy plasmids having genes encoding one or more ferritin-like molecules that are endogenous and/or exogenous to the bacteria. In one aspect, *E. coli* Nissle 1917 can be transformed with high copy plasmids having genes encoding bacterioferritin and/or high copy plasmids having genes encoding the eukaryotic H chain.

In a further embodiment, bacteria can be recombinantly engineered to express or over-express one or more siderophores (endogenous or exogenous) and/or one or more outer membrane proteins or transport proteins as described elsewhere to increase iron acquisition and transport of iron. In addition, or alternatively, bacteria can be recombinantly engineered such that one or more genes are inactivated or deleted including, but not limited to, genes encoding siderophore biosynthetic enzymes, iron-repression genes, or a combination thereof.

Tumor tissues can be specifically infected by intravenously injected *E. coli* recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells).

(b) Gram-Positive Bacteria

Gram positive bacteria also regulate iron metabolism using repressors in an iron-dependent manner.

The protein that regulates iron metabolism in *C. diphtheriae*, diphtheria toxin repressor (DtxR) protein, is a functional equivalent of the Fur repressor of Gram-negative bacteria in that it uses $Fe^{+2}$ as a co-repressor; however, it is structurally different. DtxR does not bind to operator sequences recognized by Fur. The active form is a dimer that recognizes a palindromic DNA sequence about the operator for the tox gene. DtxR-like proteins have been found in other Gram-positive bacteria, such as *Streptomyces* spp., *B. subtilis, B. lactofermentum, S. epidermidis* and *M. smegmatis*.

In *Mycobacterium* species, an iron-dependent regulator (IdeR) is a DtxR homolog; inactivation of the ideR gene in *M. smegmatis* depresses siderophore biosynthesis (Ratledge and Dover. *Annu. Rev. Microbiol.* 54: 881-941 (2000); U.S. Pat. No. 5,554,507).

In *S. aureus* and *S. epidermidis*, SirR is a metal dependent repressor that is homologous to *C. diphtheriae* DtxR. The open reading frame (ORF) of SirR sits upstream of the sit-ABC operon, and is divergently transcribed (Hill et al. *Infect Immun.* 66(9): 4123-4129 (1998)).

Bacteria, such as *C. diphtheriae*, for example, can be recombinantly engineered to inactivate expression of DtxR, such as by insertion of non-sense sequences by homologous recombination. The bacteria also can be transformed with a high copy plasmid with genes encoding ferritin-like compounds. For example, *C. diphtheriae* can be transformed with high copy plasmids having genes encoding bacterial ferritin. These methods can be included with any of the other methods provided herein to recombinantly engineer Gram-positive bacteria to express one or more of siderophores, outer membrane proteins, transport proteins, ferritins, or a combination thereof, thereby increasing the ability of the Gram-positive bacteria to acquire iron.

For example, Gram-positive bacteria can be transformed with multiple high copy plasmids having genes encoding one or more ferritin-like molecules that are endogenous and/or exogenous to the bacteria. In one aspect, *C. diphtheriae* can be transformed with high copy plasmids having genes encoding bacterioferritin and/or high copy plasmids having genes encoding the eukaryotic H chain.

In a further embodiment, bacteria can be recombinantly engineered to express or over-express one or more siderophores (endogenous or exogenous) and/or one or more outer membrane proteins or transport proteins as described elsewhere to increase iron acquisition and transport of iron.

Tumor tissues can be specifically infected by intravenously injected *C. diphtheriae* recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Bacterial cell internalization of iron in the tumor environment allows the internalization of iron alone, a supplemental imaging moiety or a therapeutic agent (which in turn delivers cytotoxicity specifically to the tumor cells).

ii. Eukaryotic Cells

Iron metabolism in eukaryotic cells is regulated primarily by post-transcriptional regulation of ferritin and the transferrin receptor at the level of mRNA stability. Levels of intracellular iron are directly sensed by two iron sensing proteins. Iron regulatory protein 1 (IRP1) is a bi-functional protein; in cells that are iron-replete, IRP1 contains an iron-sulfur cluster and functions as cytosolic aconitase. In cells that are iron-depleted, IRP1 binds stem-loop structures in mRNA transcripts of the ferritin heavy and light chains and the mammalian transferrin receptor known as iron responsive elements (IREs). Iron regulatory protein 2 (IRP2) binds similar stem-loop structures, but the mode of regulation of IRP2 is different in that IRP2 is rapidly degraded in iron-replete cells (Rouault and Klausner. *EXS.* 77:183-197 (1996); Crichton and Ward. *Analyst* 120: 693-697 (1995); Rouault and Klausner. *Curr. Top. Cell. Regul.* 35: 1-19 (1997); M. Kozak. *Annu. Rev. Cell Biol.* 8: 197-225 (1992); Aziz and Munro. *PNAS USA* 84: 8478-8482 (1987)).

Iron homeostasis is dependent upon the iron regulatory factor (IRF), a cytoplasmic protein that can bind to specific stem loops, iron responsive elements (IREs) on the messenger ribonucleic acid molecules (mRNAs) of proteins involved in iron storage (ferritin), usation (erythroid delta-aminolaevulinate synthase, AIS), and uptake (transferrin receptor). During iron depletion, the IRE exists in a high affinity form, which, by binding strongly to the corresponding mRNAs, down-regulates iron storage and usation, while up-regulating transferrin receptor expression. When the cells are iron replete, IRF-binding to IREs is weak, allowing transferrin receptor mRNA to be degraded. Under physiological conditions of iron overload and depletion, IRF functions in vivo in the manner already described for in vitro models (Crichton and Ward. *Analyst.* 120(3):693-697 (1995)).

Eukaryotic cells can be transformed with a plasmid/vector containing a gene for a ferritin molecule. For example, eukaryotic cells can be transduced with adenoviral vectors containing transgenes for the heavy and light ferritin subunits, thereby causing the cells to internalize and store iron. When injected into mice brains, the heavy and light chains of ferritin encoded by the recombinant adenovirus efficiently loaded iron and were visualized by MRI. Thus, the recombinant ferritin was an intrinsic source of MRI contrast agent (Genove et al. *Nature Medicine* 11 (4): 450-454 (2005)). In another example, over-expression of ferritin H-chain in C6 rat glioma cells increased cellular iron content in vitro and significantly increased MRI relaxation rates, both in vitro and in vivo without altering tumor growth. Over-expression of ferritin caused re-distribution of intracellular ferritin iron and chelation of intracellular free iron, thereby generating MRI contrast in vivo. In response, transferrin receptor expression increased and increased iron uptake, thereby increasing additional contrast (Cohen et al. *Neoplasia* 7(2): 109-117 (2005)).

Eukaryotic cells can be recombinantly engineered to express or over-express genes encoding H chains, L chains, transferrin receptor or a combination thereof. Tumor tissues can be specifically infected by intravenously injected eukaryotic cells recombinantly engineered as described herein. Increased iron uptake and/or storage can result in, not only, increased contrast for visualization and detection, but also iron depletion from the tumor environment. Iron depletion from the tumor environment removes a vital nutrient from the tumors, thereby dis-regulating iron hemostasis in tumor cells and delaying tumor progression and/or killing the tumor. Additionally, iron can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Eukaryotic cell internalization of iron in the tumor environment allows the internalization of iron alone, a supplemental imaging moiety or a therapeutic agent (which in turn delivers cytotoxicity specifically to the tumor cells).

2. Ligand Binding a. Therapeutic Agents

The microorganisms and cells provided herein can bind a ligand, such as, a siderophore, a peptide, a protein, an antibody or a nanoparticle that has been conjugated to a therapeutic agent or a detectable moiety. The ligand can bind to an endogenous or exogenous protein or peptide (e.g., a siderophore receptor), or a recombinant molecule (e.g., OmpA with a peptide inserted in one of the outer loops). The ligand can be conjugated to a detectable moiety or a therapeutic agent. A mixture of ligands conjugated to one or more detectable moieties, one or more therapeutic agents, or a combination thereof is provided herein.

Exemplary therapeutic agents include, for example, cytokines and growth factors, photosensitizing agents, toxins, anticancer antibiotics, chemotherapeutic compounds, radionuclides, angiogenesis inhibitors, sugar-containing compounds, signaling modulators, anti-cancer antibodies, or a combination thereof. Examples of therapeutic agents are provided elsewhere herein.

Antibodies immunoreactive with tumor-associated antigens have been shown to home specifically to tumorous tissue compared to non-tumorous tissue. For example, a monoclonal antibody specific for the human epidermal growth factor receptor type 2 (HER2), Trastuzumab (HERCEPTIN) is a standard therapeutic option for treatment of metastatic breast cancers (Emens and Davidson. *Oncology* 18(9): 1117-28 (2004)). The use of such antibodies, either alone, or coupled with an anti-cancer agent, is well-known in the art. In one instance, antibodies immunoreactive with the HER2 receptor blocked intracellular signaling and had anti-tumor effects when administered alone, or with chemotherapy (Bianco A R, *J. Chemother.* 16 (Suppl 4): 52-54 (2004)).

b. Detectable Moieties

Detectable moieties and imaging moieties refer to moieties used to image an . microorganism or cell in any of the methods provided herein, such as, for example, detectable labels, or bindable moieties such as bindable compounds. Detectable moieties and imaging moieties include, for example, bioluminescent moieties, fluorescent moieties, a chemiluminescent moieties, radionuclides, magnetically detectable isotopes or compounds, sonographic imaging agents, chromophores, latex microspheres, quantum dots, chemiluminescent moieties, bioluminescent moieties, and metals, such as a colloidal metal, silica-encapsulated fluorescent dyes, gold nanoparticles (nanoshells) or any other moiety that can be used for detection by methods provided herein. Exemplary luminescent proteins, include, but are not limited to genes encoding light-emitting proteins (or derivatives or analogs thereof) including genes from bacterial luciferase from *Vibrio harveyi* or *Vibrio fischerii, Photorhabdus luminescens*, firefly luciferase, click beetle luciferase aequorin from *Aequorea victoria*, and *Renilla luciferase* from *Renilla reniformis*. Exemplary fluorescent proteins, include, but are not limited to mutants or variants of green fluorescent protein (GFP) from *Aequorea victoria* (Prasher et al., *Gene* 111: 229-233 (1987)) or *Renilla* sea pansy, and other sea anemone and coral species, and variants thereof, including yellow fluorescent protein (YFP), orange fluorescent protein (OFP), cyan fluorescent protein (CFP), and blue fluorescent protein (BFP), red fluorescent protein (RFP) and far-red fluorescent protein from the corallimorph Discosoma (Matz et al., *Nature Biotechnology* 17: 969-973 (1999)), *Heteractis* reef coral and other sea anemone and coral species, as well as variants thereof, including DsRed2 (Clontech, Palo Alto, Calif.), DsRed-T1 (Bevis and Glick, *Nat. Biotechnol.*, 20: 83-87 (2002)), mPlum (Wang et al., *Proc. Natl. Acad. Sci. U.S.A.* 101(48):16745-9 (2004)), HcRed1 and t-HcRed (Clontech, Palo Alto, Calif.), and near-infrared fluorescent proteins. Exemplary chemiluminescent moieties include, for example, luminol, isoluminol, acridinium esters, thioesters and sulfonamides, and phenanthridinium esters.

c. Targeting of Peptides

Peptides can be used as ligands to image or treat tumors using any of the methods provided herein. Targeting of peptides to specific tumor blood vessels, tissues and organs is well-known in the art. In one instance, a short fusion peptide having a tumor blood vessel "homing" motif and a programmed cell-death-inducing sequence guided the peptide to the targeted cells and had anti-cancer activity in mice (Ellerby et al. *Nat. Med.* 5(9): 1032-1038 (1999); Pasqualini and Ruoslahti, *Nature* 380: 364-366 (1996)). Phages that display a surface peptide with a NGR sequence motif coupled to a drug have been shown to home to tumor vasculature in vivo and have anti-tumor effects (Arap et al. *Science* 279: 377-380 (1998); Pasqualini et al. *Cancer Res.* 60: 722-727 (2000)). Other phages carrying lung-specific peptides, fragments of the HMGN2 protein, and peptides of angiogenesis-related markers specific to blood vessels of tumors have also been identified (Laakkonen et al. *Nature Medicine* 8(7): 751-755 (2002); Porkka et al. *PNAS* 99(11): 7444-7449 (2002); Rajotte and Ruoslahti. *J. Biol. Chem.* 274(17): 11593-11598 (1999)).

Generally, when bacterial outer membrane proteins are used for display of heterologous peptides or proteins, it is achieved through genetic insertion into permissive sites of the carrier proteins. A streptavidin peptide ligand has been displayed in the *E. coli* strain MC1061 outer membrane protein A (OmpA) using bacterial display methodology as described above. Other peptides of 15-514 amino acids have been displayed in the second, third, and fourth outer loops on the surface of OmpA as described above. Thus, outer membrane proteins can carry and display heterologous gene products on the outer surface of bacteria.

Bacteria can be recombinantly engineered to express a peptide ligand, such as, for example, on an outer membrane protein on the cell surface. The bacteria can be transformed with a plasmid carrying genes encoding recombinant cell surface molecules, such as, but not limited to, an outer membrane protein with a peptide ligand inserted in a permissible site. Such techniques are known to one of skill in the art.

For example, *E. coli* Nissle 1917 can be transformed with plasmids carrying genes encoding OmpA with a streptavidin binding peptide (SA-B/OmpA) or a S-peptide (SPep/OmpA) as described in the Examples.

In another embodiment, *E. coli* Nissle 1917 can be transformed with plasmids carrying genes encoding the HER2/neu receptor.

A mixture of *E. coli* Nissle 1917 carrying a combination of genes can be prepared using methods known in the art and provided herein, such as by transforming bacteria with plasmids. The plasmids can be, for example, high copy plasmids which cause over-expression of the recombinant polypeptide of interest.

Eukaryotic cells can be recombinantly engineered to express a peptide ligand, such as, for example, on an outer membrane protein on the cell surface. The eukaryotic cells can be transfected with genes encoding recombinant cell surface molecules, such as, but not limited to, a membrane protein with a peptide ligand inserted in a permissible site. Such techniques are known to one of skill in the art.

Viruses can be recombinantly engineered to carry genes encoding a membrane protein with a peptide ligand inserted in the sequence to be expressed on the surface of infected tumor cells and/or part of the viral envelope. Such techniques are known to one of skill in the art.

Tumor tissues can be specifically infected by intravenously injected microorganisms and cells recombinantly engineered using any of the methods provided herein. Concomitant with, or subsequent to, injection of the recombinant microorganism, the corresponding ligand conjugated to a detectable moiety, a therapeutic agent or a mixture thereof can be injected. For example, concomitant with, or subsequent to, injection of the recombinant microorganism or cell carrying genes for a streptavidin binding peptide or a S-peptide, the ligand for each peptide can be intravenously injected. In another example, concomitant with, or subsequent to, injection of the recombinant microorganism or cell carrying genes for the HER2/neu receptor, Herceptin® can be intravenously injected.

In some cases, the detectable moiety and therapeutic agent are the same, e.g., a radionuclide. In one embodiment, imaging is conducted using a radionuclide at a detectable concentration, a tumor is imaged, and therapy is conducted by administering a radionuclide at a therapeutic concentration. Homing of the ligand to the microorganism or tumor cell surface allows for selective imaging and/or therapy of the tumors. The diagnostic agent can be optimized for use in any of the imaging methods provided herein. The therapeutic agent can prevent progression of tumor development or kill the tumor cells. The method allows for combination diagnosis and therapy of the tumor using the same recombinantly engineered microorganism.

d. Targeting of Nanostructures

Nanostructures that interface with biological systems have attracted widespread interest in biology and medicine. Nanoparticles are small particles with a diameter of no more than 500 nm can be used for both diagnostic and therapeutic purposes. Successful nanoparticle delivery includes the ability to target specific tissues and cell types. The nanoparticles can, for example, carry substances for MRI imaging and be used as MRI contrast agents. Bimodal nanoparticles carrying a near-infrared optically-detectable fluorochrome conjugated to an MRI contrast agent have been used for imaging tumors. By coupling specific ligands, nanoparticles can be made microorganism-, tissue- and/or cancer-specific.

Tumor targeting/replicating bacteria and eukaryotic cells can be used to display specific ligands on their surface to attract and bind nanoparticles. Tumor targeting/replicating viruses can be used to display specific ligands on the surface of tumor cells to attract and bind nanoparticles. Nanoparticles can be coated with a multitude of ligands, such as, but not limited to, peptides, proteins, antibodies, or fusion products (i.e., conjugates) thereof. This binding can lead to enhanced diagnostic signals and can be used for tumor therapy.

i. Nanoparticle-Peptide/Protein Conjugates

Nanoparticles are inorganic nanostructures that have therapeutic and diagnostic purposes. One type of nanoparticle is semiconductor quantum dots (qdots), which are small (<10 nm) inorganic nanocrystals possessing fluorescent properties. Peptides that home to vascular markers (e.g., tumor vasculature) have been coated onto qdots using a thiol-exchange reaction, and the coupled qdots have been shown to target tumor vasculature over non-tumor vasculature when injected intravenously into mice. The qdots can be co-coupled with a substance, such as polyethylene glycol (PEG), that reduces aggregation of the qdots, helps maintain solubility in aqueous solvents and minimizes non-specific binding (Å kerman et al. *PNAS* 99(20): 12617-12621 (2002)).

Targeting of peptides to specific tumor blood vessels, tissues and organs is well-known in the art as described above.

Bacteria and eukaryotic cells can be recombinantly engineered to express a peptide ligand on the cell surface. The peptide ligand can be recombinantly engineered as a fusion protein, wherein the peptide ligand is fused to a protein that is expressed on the surface of the cell. The bacteria can be transformed with a plasmid carrying genes that encode the peptide ligand or peptide ligand fusion protein such that the genes remain on the plasmid or are genomically integrated. An non-limiting example of a cell surface molecule that can be used to engineer a recombinant molecule is an outer membrane protein. The sequence encoding the peptide ligand can be inserted at either end of the sequence encoding the cell surface molecule or within the sequence encoding the cell surface molecule. For example, *E. coli* Nissle 1917 can be transformed with plasmids carrying genes encoding OmpA with a streptavidin binding peptide (SEQ ID NOS.: 5-7; SA-B/OmpA) or a S-peptide (SEQ ID NO: 64; SPep/OmpA) on one of the extracellular outer loops of the protein using methods known in the art and as described in the Examples. A mixture of bacteria expressing both peptides can be prepared. Exemplary Spep sequences include, but are not limited to SEQ ID NOS: 43 and 48.

The plasmids can be, for example, plasmids which cause over-expression of the recombinant polypeptide of interest via strong promoters. Genes that are integrated into the microbial chromosome can be placed under the control of a strong promoter such that genes of interest are over-expressed. One of skill in the art could select a promoter based on the level of expression desired for a particular gene.

For example, eukaryotic cells can be transfected with genes a encoding membrane protein with a streptavidin binding peptide or a S-peptide inserted into a permissible site in the extracellular portion of membrane protein using methods known in the art. A mixture of eukaryotic cells expressing both peptides can be prepared or each eukaryotic cell can express several peptides.

Viruses can be recombinantly engineered to carry genes encoding a membrane protein with a peptide ligand inserted in the sequence to be expressed on the surface of infected tumor cells and/or part of the viral envelope.

Nanoparticles can be coated with a particular ligand and a detectable moiety, a therapeutic agent or a combination thereof such that the nanoparticles home to the recombinant peptide and bind, thus, delivering the detectable moiety and/or therapeutic agent specifically to the tumor.

Tumor tissues can be specifically infected by intravenously injected microorganisms and cells recombinantly engineered as described herein. Concomitant with, or subsequent to, injection of the recombinant microorganism, nanoparticles coated with the corresponding ligand and a detectable moiety, a therapeutic agent or a combination thereof can be injected. The detectable moiety and/or therapeutic agent can be conjugated to the ligand or can be coated on the nanoparticle itself. In some cases, the detectable moiety and therapeutic agent are the same, e.g., a radionuclide. The nanoparticles can be coated with a substance, such as PEG, to reduce aggregation of the nanoparticles. Homing of the nanoparticle to the microorganism or tumor cell allows for imaging and or therapy of the tumors. The therapeutic agent can prevent progression of tumor development or kill the tumor cells. The diagnostic agent can be optimized for use in any of the imaging methods provided herein. The method allows for combination diagnosis and therapy of tumors using the same recombinantly engineered microorganism.

ii. Nanoparticles-Antibodies Conjugates

Molecular imaging of tumor antigens using immunospecific magnetic resonance (MR) contrast agents has been shown to aid in early disease detection, monitoring of treatment efficacy and drug development. Magnetite particles are superparamagnetic and have a significantly larger magnetic moment than paramagnetic compounds. The detection limit for magnetite particles in MRI is in the subnanomolar range, which is orders of magnitudes better than the micromolar detection limit of gadolinium (Weissleder et al. *Radiology* 175: 489-493 (1990)). Antibodies immunoreactive with, or that specifically bind to, tumor surface antigens (e.g., the HER2/neu receptor and 9.2.27 proteoglycan sulfate), have been covalently coupled to small iron oxide (magnetite) particles and were effective in detecting melanoma cell lines as well as mammary carcinoma cell lines in vivo (Funovics et al. *Magnetic Resonance Imaging* 22: 843-850 (2004)).

Bacterial cells can be recombinantly engineered to express a peptide ligand on an outer membrane protein on the cell surface. Bacteria can be transformed with a plasmid carrying genes encoding exogenous receptors or recombinant cell surface molecules, such as, but not limited to, an outer membrane protein with a peptide ligand inserted in the sequence. In one embodiment, *E. coli* Nissle 1917 can be transformed with plasmids carrying genes encoding OmpA with a streptavidin binding peptide (SA-B/OmpA) or a S-peptide (SPep/OmpA) as described in the Examples. In another embodiment, *E. coli* Nissle 1917 can be transformed with plasmids carrying genes encoding the HER2/neu receptor.

Eukaryotic cells can be recombinantly engineered to carry genes encoding exogenous receptors or recombinant cell surface molecules, such as, but not limited to, a membrane protein with a peptide ligand inserted in the sequence.

Viruses can be recombinantly engineered to carry genes encoding exogenous receptors or recombinant cell surface molecules, such as, but not limited to, a membrane protein with a peptide ligand inserted in the sequence (and a signal peptide for cell surface expression) for expression of the recombinant molecule on the surface of infected tumor cells and/or part of the viral envelope.

Tumor tissues can be specifically infected by intravenously injected microorganisms and cells recombinantly engineered as described herein. Concomitant with, or subsequent to, injection of the recombinant microorganism, nanoparticles coated with antibodies that selectively bind to the peptide or receptor can be intravenously injected.

The nanoparticle also can be coated with any of the detectable moieties and/or therapeutic agents provided herein. Alternatively, the antibodies provided herein can be conjugated to any of the detectable moieties and/or therapeutic agents provided herein. In some cases, the detectable moiety and therapeutic agent are the same, e.g., a radionuclide. In a further embodiment, the nanoparticles can be coated with a substance, such as PEG, to reduce aggregation or reduce uptake into the reticuloendothelial system (RES). In addition, antibodies used in the methods herein can be specific for a surface protein on the microorganism.

Homing of the antibody to ligand presented on the microorganism or tumor cell surface allows for imaging and or therapy of the tumors. The therapeutic agent can prevent progression of tumor development or kill the tumor cells. The diagnostic agent can be optimized for use in any of the imaging methods provided herein. The method allows for combination diagnosis and therapy of the tumor using the same recombinantly engineered microorganism.

iii. Nanoparticle-Protein Conjugates

In vivo magnetic resonance imaging (MRI) of nanoparticle conjugates has been assessed in a transgene expression system. Specifically, transgenic mice were generated that expressed an engineered transferrin receptor. Monocrystalline iron oxide nanoparticles (MION) were sterically protected with a layer of dextran and covalently conjugated to human holo-transferrin. Gliosarcoma cells were stably transfected with cells expressing the engineered transferrin receptor or control cells. Tumors were established in nude mice and administered transferrin-MION conjugates. In vivo MRI analysis showed that the transferrin-MION conjugates were localized to tumors with the engineered transferrin receptor (Weissleder et al. *Nat. Medicine* 6(3): 351-354 (2000)).

Tat protein-derived peptide sequences have been used to internalize a number of marker proteins into cells (Schwarze et al. Science 285: 1569-1572 (1999)). In another example, superparamagnetic nanoparticles have been coated with dextran and Tat protein-derived peptide sequences; the particles were efficiently incorporated into cells. Cells also could be tagged with a triple label of (magnetic, fluorescent, isotope) superparamagnetic nanoparticles conjugated to Tat protein-derived peptide sequences and visualized with MRI. Such methods target Tat-nanoparticle conjugates to CD34+ cells (Lewin et al. *Nature Biotechnology* 18: 410-414 (2000)).

Microorganisms and cells can be recombinantly engineered to express an exogenous receptor. The microorganism or cell can carry genes encoding such recombinant receptors. In one non-limiting example, a microorganism, such as a bacteria, a virus or a eukaryotic cell can be recombinantly engineered to carry genes encoding a transferrin receptor, a lactoferrin receptor or a combination thereof. The plasmids can be, for example, plasmids which cause over-expression of the recombinant polypeptide of interest using a strong promoter. In one non-limiting embodiment, tumor tissues can be specifically infected by intravenously injected bacteria, virus or eukaryotic cell recombinantly engineered to over-express the transferrin receptor.

By virtue of the ability of the microorganisms and cells to home to tumor environments, transferrin receptor expression would be increased in the tumor environment. Concomitant with, or subsequent to, injection of the recombinant microorganism, nanoparticles coated with the corresponding ligand (e.g., transferrin or lactoferrin) and a detectable moiety, a therapeutic agent or a combination thereof can be injected. In a further embodiment, the nanoparticles can be coated with a substance, such as PEG, to reduce aggregation and reduce uptake into the reticuloendothelial system (RES). The detectable moiety and/or therapeutic agent can be conjugated to the ligand or can be coated on the nanoparticle itself. In some cases, the detectable moiety and therapeutic agent are the same, e.g., a radionuclide. Homing of the nanoparticle to the microorganism or cell allows for imaging and/or therapy of the tumor cells. The therapeutic agent can prevent progression of tumor development or kill the tumor cells. The diagnostic agent can be optimized for use in any of the imaging methods provided herein. The method allows for combination diagnosis and therapy of the tumor using the same recombinantly engineered microorganism.

e. Siderophores

Endogenous or exogenous siderophores can be conjugated to any of the detectable moieties or therapeutic agents provided herein and used in any of the methods provided herein. Recombinantly engineered microorganisms and cells expressing or over-expressing siderophores and their receptors have been described above. Alternatively, or in addition, recombinantly engineered microorganisms and cells containing inactivated DNA such that siderophores are not expressed have been described above.

In one non-limiting embodiment, a microorganism such as a bacteria (e.g., *E. coli* Nissle 1917), a virus (e.g., Vaccinia virus), or a eukaryotic cell can be recombinantly engineered with genes encoding a receptor of interest. In one non-limiting embodiment, tumor tissues can be specifically infected by intravenously injected microorganisms and cells recombinantly engineered as described herein. For example, a microorganism such as a bacteria (e.g., *E. coli* Nissle 1917), a virus (e.g., Vaccinia virus), or a eukaryotic cell can be recombinantly engineered with genes encoding the ferrichrome receptor, FhuA. By virtue of the ability of microorganism to home to tumor environments, FhuA expression would be localized to the bacterial, eukaryotic or tumor cell surface. Concomitant with, or subsequent to, injection of the recombinant microorganism, ferrichrome conjugated to any of the detectable moieties provided herein can be intravenously injected. Following in vivo imaging of the tumor using any of the methods provided herein, ferrichrome conjugated to any of the therapeutic agents provided herein can be intravenously injected for localized therapy of the imaged tumor. The detectable moiety and the therapeutic agent can be the same molecule (e.g., a radionuclide) or different molecules (e.g., a chemotherapeutic agent and an anti-cancer antibody). The therapeutic agent can prevent progression of tumor development or kill the tumor cells. The method allows for combination diagnosis and therapy of the tumor using the same recombinantly engineered microorganism.

D. METHODS OF MODIFYING MICROORGANISMS AND CELLS

The microorganisms and cells provided herein can be modified from their wild-type form. Modifications can include any of a variety of changes, and typically include changes to the genome or nucleic acid molecules of the microorganisms and cells. The microorganisms and cells provided herein can be formed by standard methodologies well known in the art for modifying microorganisms and cells such as viruses, bacteria and eukaryotic cells. Briefly, the methods include introducing into microorganisms and cells one or more genetic modification(s), followed by screening the microorganisms and cells for properties reflective of the modification(s) or for other desired properties. Exemplary nucleic acid molecular modifications include truncations, insertions, deletions and mutations. In an exemplary modification, a microorganism or cell can be modified by truncation, insertion, deletion or mutation of one or more genes. In an exemplary insertion, an exogenous gene such as, for example, streptavidin binding peptide, can be inserted into the genome of the microorganism or cell or provided on a plasmid. In an exemplary modification, an endogenous gene, an exogenous gene or a combination thereof can be inserted into a plasmid which is inserted into the microorganism or cell using any of the methods known in the art. In an exemplary deletion/mutation, a gene, such as, for example, the fur repressor consensus sequence, can be inactivated by homologous recombination techniques in combination with any of the other methods provided herein. Methods for optimizing expression genes are known in the art and include, for example, modification of copy number, promoter strength, deletion of genes that encode inhibitory proteins, or movement of essential genes to a plasmid in order to maintain the plasmid in the transformed bacteria.

The microorganisms and cells provided herein can be formed by standard methodologies well known in the art for modifying microorganisms and cells such as viruses, bacteria and eukaryotic cells. Briefly, the methods include introducing into microorganisms and cells one or more genetic modification, followed by screening the microorganisms and cells for properties reflective of the modification or for other desired properties. Modifications of the microorganisms and cells provided herein can result in a modification of microorganismal characteristics, including, but not limited to, those provided herein such as pathogenicity, toxicity, ability to preferentially accumulate in tumor, ability to lyse cells or cause cell death, replication competence, increased capacity to capture iron or other metals, increased capacity to transport iron, increased capacity to store iron, bind a ligand, or a combination thereof.

Standard techniques in molecular biology can be used to generate the modified microorganisms and cells provided herein. Such techniques include various nucleic acid manipulation techniques, nucleic acid transfer protocols, nucleic acid amplification protocols, and other molecular biology techniques known in the art. For example, point mutations can be introduced into a gene of interest through the use of oligonucleotide mediated site-directed mutagenesis. Alternatively, homologous recombination techniques can be used to introduce a mutation or exogenous sequence into a target sequence of interest; or can be used to inactivate a target sequence of interest. Nucleic acid transfer protocols include calcium chloride transformation/transfection, transduction, electroporation, liposome mediated nucleic acid transfer, N-[1-(2,3-Dioloyloxy)propyl]-N,N,N-trimethylammonium methylsulfate meditated transformation, and others. In an alternative mutagenesis protocol, point mutations in a particular gene can also be selected for using a positive selection pressure. See, e.g., Current Protocols in Molecular Biology. Ed. Ausubel et al. John Wiley & Sons, Inc. Cambridge, Mass., 1995. Nucleic acid amplification protocols include but are not limited to the polymerase chain reaction (PCR). Use of nucleic acid tools such as plasmids, vectors, promoters and other regulating sequences, are well known in the art for a large variety of viruses and cellular organisms. Further a large variety of nucleic acid tools are available from many different sources including the American Type Culture Collection (ATCC), and various commercial sources. One skilled in the art will be readily able to select the appropriate tools and methods for genetic modifications of any particular virus or cellular organism according to the knowledge in the art and design choice.

Any of a variety of modifications can be readily accomplished using standard molecular biological methods known in the art. The modifications will typically be one or more truncations, deletions, mutations or insertions of the microorganismal genome. In one embodiment, the modification can be specifically directed to a particular sequence. The modifications can be directed to any of a variety of regions of the microorganismal genome or endogenous plasmids, including, but not limited to, a regulatory sequence, to a gene-encoding sequence, or to a sequence without a known role. Any of a variety of regions of microorganismal genomes that are available for modification are readily known in the art for many microorganisms and cells, including the microorganisms and cells specifically listed herein.

1. Recombinant DNA Technology

Display of heterologous proteins in the cytosol of microorganisms and cells, on the surface of microorganisms and cells or secreted by microorganisms and cells, enabled by means of recombinant DNA technology, has become an increasingly used strategy in various applications in microbiology, biotechnology and vaccinology. Gram negative, Gram positive bacteria, viruses, eukaryotic cells and phages are all being investigated for such applications. Live bacterial vaccine delivery vehicles are being developed through the surface display of foreign antigens on the bacterial surfaces. Live bacteria delivery vehicles also can be developed such that bacteria make recombinant gene products that are located in the cytosol or that are secreted. The polypeptides encoded by the recombinant genes can aid in diagnostic or therapeutic methods described herein. Bacteria can be engineered with plasmids to produce one or more polypeptides of interest. Homologous recombination can also be conducted to inactivate regulatory or other such genes on a bacterial chromosome and to insert recombinant genes on the bacterial chromosome. Thus, bacteria can be used as new types of whole-cell diagnostic devices.

Variants can be obtained by general methods such as mutagenesis and passage in bacterial, cell or tissue culture and selection of desired properties, as is known in the art. Variants also can be obtained by mutagenic methods in which nucleic acid residues of the microorganism or cell are added, removed or modified relative to wild type. Any of a variety of known mutagenic methods can be used, including recombination-based methods, restriction endonuclease-based methods, chemical mutagenesis and PCR-based methods. Mutagenic methods can be directed against particular nucleotide sequences such as genes, or can be random, where selection methods based on desired characteristics can be used to select mutated microorganisms and cells. Any of a variety of microorganismal modifications can be made, according to the selected microorganism or cell and the particular known modifications of the selected microorganism. Methods for introduction of genetic material into bacteria are available and known in the art, including, but not limited to, plasmid transformation and phage transduction, using vectors such as P1 or lambda bacteriophage vectors (cosmids), which can contain transposons.

a. Endogenous Gene Expression

Methods for recombinantly engineering microorganisms and cells are well-known in the art. Methods include, but are not limited to, oligonucleotide-directed in vitro mutagenesis to introduce genes into plasmids are well known in the art.

Plasmids can be created to carry genes using methods known to one skilled in the art. High copy plasmids can be used to cause over-expression of endogenous proteins in microorganism. Plasmids for expression of proteins include, but are not limited to ColE1, pBR322, p15A, pEMBLex2, pMAL-p2, pUC18A2 (a pUC18-derived plasmid containing the ftn gene), pUC118, pGS281, pMK4, pUNK1, pAMβ1 and pTA1060. Choice of a plasmid for expression at desired levels is well-known in the art as well as techniques to introduce genes into the plasmids (Sambrook et al. Molecular Cloning: A Laboratory Manual. $2^{nd}$ ed. Cold Spring Harbor Laboratory Press, New York, N.Y. 1989; Current Protocols in Molecular Biology. Ed. Ausubel et al. John Wiley & Sons, Inc. Cambridge, Mass., 1995).

b. Exogenous Gene Expression

In some embodiments, the microorganism or cell can be modified to express an exogenous gene. Exemplary exogenous gene products include proteins and RNA molecules. The modified microorganisms and cells can express a detectable gene product, a therapeutic gene product, a protein that serves as a binding site for a ligand. For example, bacteria can be recombinantly engineered with a peptide inserted into a permissible site of an endogenous protein (e.g., OmpA) or can be recombinantly engineered with an exogenous receptor (e.g., the HER2/neu receptor). The characteristics of such gene products are described herein and elsewhere. In some embodiments of modifying an organism to express an exogenous gene, the modification can also contain one or more regulatory sequences to regulate expression of the exogenous gene. As is known in the art, regulatory sequences can permit constitutive expression of the exogenous gene or can permit inducible expression of the exogenous gene. Further, the regulatory sequence can permit control of the level of expression of the exogenous gene. In some examples, inducible expression can be under the control of cellular or other factors present in a tumor cell, present in a microorganism-infected tumor cell, or present in/on an extracellular microorganism or cell localized in a tumor environment. In other examples, inducible expression can be under the control of an administrable substance, including arabinose, IPTG, RU486 or other known induction compounds. Any of a variety of regulatory sequences are available to one skilled in the art according to known factors and design preferences. In some embodiments, the regulatory sequence can result in constitutive, high levels of gene expression. In tumor therapy embodiments, a therapeutic protein can be under the control of an internally inducible promoter or an externally inducible promoter. In some examples, the inducible promoter is a sugar-inducible promoter, such as an arabinose-inducible promoter. Recombinant microorganism or cells that contain an sugar-inducible promoter for the expression of exogenous genes can be modified to decrease or abolish the metabolic breakdown of the inducing sugar. For example, bacteria, such as *E. coli*, can be modified such that the breakdown and/or utilization of arabinose in the bacteria is reduced or abolished, which allows for greater accumulation of arabinose in the cells leading to higher gene induction of and longer gene expression from arabinose-inducible promoters in the recombinant bacteria.

The microorganisms and cells provided herein also can have the ability to express one or more exogenous genes. Gene expression can include expression of a protein encoded by a gene and/or expression of an RNA molecule encoded by a gene. Expression of exogenous genes can be controlled by a constitutive promoter, or by an inducible promoter. Expression can also be influenced by one or more proteins or RNA molecules expressed by the microorganism. Genes can be encoded in a microorganismal chromosome or on a plasmid. Over-expression of a gene or gene product can be achieved by insertion of a gene into the microorganismal chromosome under the control of a strong promoter. Plasmids can be created to carry genes using methods known to one skilled in the art. A high copy plasmids can be used to cause over-expression of exogenous proteins in microorganism. Plasmids for expression of proteins include, but are not limited to ColE1, pBR322, p15A, pEMBLex2, pMAL-p2, pUC18A2 (a pUC18-derived plasmid containing the ftn gene), pUC118, pGS281, pMK4, pUNK1, pAMβ1 and pTA1060. Choice of a plasmid for expression at desired levels is well-known in the art as well as techniques to introduce genes into the plasmids (Sambrook et al. Molecular Cloning: A Laboratory Manual. $2^{nd}$ ed. Cold Spring Harbor Laboratory Press, New York, N.Y. 1989; Current Protocols in Molecular Biology. Ed. Ausubel et al. John Wiley & Sons, Inc. Cambridge, Mass., 1995).

For example, bacteria have a number of different ways to secrete and attach proteins to their surface. Gram positive (G+) bacteria mainly secrete proteins using Sec-dependent protein secretion machinery or the TAT-transporter to translocate proteins over the cell membrane. They use different proteins (sortases) to attach some of the secreted proteins to the cell wall. Signal peptides target the proteins for efficient secretion and attachment, with the signal being cleaved from the mature surface protein during the secretion process. In Gram negative (G−) bacteria, at least 5 different types of protein secretion are known (Types I-V). While the type I secretion system uses the C-terminal protein sequence as a secretion signal, other systems use N-terminal signal sequences. Attachment to the bacterial surface is not mediated by linking it to the peptidoglycan, as is the case for Gram positive bacteria. Rather, the proteins on the gram negative bacterial surface have a transmembrane moiety that is embedded in the outer membrane of the bacteria (Choi and Lee. *Appl. Microbiol. Biotechnol.* 64: 625-635 (2004); Palmer et al. *Trends in Microbiol.* 13(4): 175-180 (2005)). In some embodiments, bacteria can be engineered to express ligands on their surface that attract therapeutic agents to the bacteria. In other embodiments, siderophores or nanoparticles, which selectively move to bacteria in the tumors can also be conjugated to therapeutic agents. Siderophores or nanoparticles can also be conjugated to therapeutic agents and to a receptor that recognizes a ligand expressed on the surface of the bacteria, for example, as a fusion with an outer membrane protein. Additional systems for cell surface expression include, but are not limited to, lipoprotein, ice nucleation protein, Fimbrial, LamB PhoE, TolC and FliC systems.

In other embodiments, siderophores or nanoparticles, can be conjugated to a protein that binds to a ligand bound to the cell surface. For example, a siderophore or nanoparticle conjugated to a streptavidin protein can bind to a biotin-TMR or -diAcFAM ligand fusion protein that is bound to a modified hydrolase protein expressed on the surface of a bacterium (Halotag system, Promega).

i. Outer Membrane Proteins (Omp)

Generally, when outer membrane proteins are used for display of heterologous peptides or proteins, it is achieved through genetic insertion into permissive sites of the carrier proteins. Expression of a heterologous peptide or protein is dependent on the structural properties of the inserted protein domain, since the peptide or protein is more constrained when inserted into a permissive site as compared to fusion at the N- or C-terminus of a protein.

Peptides displayed on the surface of filamentous bacteriophages or phage display provide a versatile and effective method for isolation of peptide ligands binding to a diverse array of targets. Peptide libraries have been constructed in *E. coli* as insertions in extracellular proteins (e.g., pili and flagella subunits) or as insertions into outer membrane proteins. A streptavidin peptide ligand has been displayed in the *E. coli* strain MC1061 outer membrane protein A (OmpA) using bacterial display methodology (Lee et al., *Trends Biotechnol.* 21: 45-52 (2003); Lu et al., *Biotechnology* (NY) 13: 366-372 (1995); Camaj et al., *Biol. Chem.* 382: 1669-1677 (2001); Bessette et al. *Prot. Eng., Design & Sel.* 17(10): 731-739 (2004)). Other peptides of 15-514 amino acids have been displayed in the second, third, and fourth outer loops on the surface of OmpA (Samuelson et al. *J. Biotechnol.* 96: 129-154 (2002)). Thus, outer membrane proteins can carry and display heterologous gene products on the outer surface of Gram negative bacteria.

Proteins in the outer membrane or periplasmic space are usually synthesized in the cytoplasm as premature proteins, which are cleaved at a signal sequence to produce the mature protein that is exported outside the cytoplasm. Exemplary signal sequences used for secretory production of recombinant proteins for *E. coli* have been identified. The N-terminal amino acid sequence, without the Met extension, can be obtained after cleavage by the signal peptidase when a gene of interest is correctly fused to a signal sequence. Thus, a mature protein can be produced without changing the amino acid sequence of the protein of interest (Choi and Lee. *Appl. Microbiol. Biotechnol.* 64: 625-635 (2004)). Thus, outer membrane proteins can be used to express exogenous gene products, such as a peptide on the surface of any of the modified microorganisms and cells provided herein.

ii. Lpp'OmpA

LPP'OmpA proteins provide a system that efficiently displays outer surface proteins and combines the benefits of efficient surface display of outer membrane proteins and which allowed C-terminal fusions. *E. coli* lipoprotein (LPP) differs from other outer membrane proteins because all the information for targeting and insertion into the outer membrane is in the signal sequence and the first nine N-terminal amino acids (collectively denoted LPP'). Fusions to the short LPP'sequence become fatty acylated, exported via the lipoprotein pathway and inserted into the outer membrane but are not surface exposed. The LPP'system has been successfully used to create a number of fusion proteins to display proteins in a functional form on *E. coli* (Francisco et al., *PNAS USA* 89: 2713-2717 (1992); Georgiou et al. *Protein Eng.* 9: 239-247 (1996)). Thus, LPP'OmpA proteins can be used to express exogenous gene products, such as a peptide ligand, on the surface of modified microorganisms and cells provided herein.

iii. Lipoproteins

Lipoproteins refer to a group of bacterial proteins that are anchored to the outer membrane via a covalently attached lipid moiety. *E. coli* peptidoglycan-associated lipoprotein (PAL) has been used as a carrier of proteins for presentation at the surface of the cell. Recombinant DNA technology was used to create a fusion of PAL and a single chain antibody fragment Samuelson et al. *J. Biotechnology* 96: 129-154 (2002)). Thus, lipoproteins can be used to express exogenous gene products, such as a peptide ligand, on the surface of modified microorganisms and cells provided herein.

iv. Ice-Nucleation Protein (Inp)

Inp (or InaZ) is normally anchored to *Pseudomonase syringae* cells via a glycosylphosphatidyl-inositol (GPI)-anchor sequence. Fusion constructs of levansucrase to the C-terminus of Inp cause surface expression of levansucrase in *E. coli*, resulting in surface localized enzyme activity. Inp has also been used for displaying antigens, enzymes and single-chain antibodies (Jung et al., *Nat. Biotechnol.* 16: 576-580 (1998); Jung et al., *Enzyme Microb. Technol.* 22: 348-354 (1998); Kim et al., *Appl. Environ. Microbiol.* 66: 788-793 (2000); Jeong et al., *Enzyme Microb. Technol.* 28: 155-160 (2001); Shimazu et al., *Biotechnol. Prog.* 17: 76-80 (2001); Bassi et al., *Biotechnol. Prog.* 16: 557-563 (2000); Kim and Yoo. *Lett. Appl. Microbiol.* 29: 292-297 (1999); and Lee et al., *Infect. Immunol.* 67: 1511-1516 (1999)). Thus, Inp can be used to express exogenous gene products, such as a peptide ligand, on the surface of modified microorganisms and cells provided herein.

v. Detectable Gene Product

The microorganisms and cells provided herein can express one or more genes whose products are detectable or whose products can provide a detectable signal. A variety of detectable gene products, such as detectable proteins are known in the art, and can be used with the microorganisms and cells provided herein. Detectable proteins include receptors or other proteins that can specifically bind a detectable compound, proteins that can emit a detectable signal such as a fluorescence signal, enzymes that can catalyze a detectable reaction or catalyze formation of a detectable product.

In some embodiments, the microorganism or cell expresses a gene encoding a protein that can emit a detectable signal or that can catalyze a detectable reaction. Exogenous genes expressed can include genes encoding a therapeutic gene product or genes encoding a detectable gene product such as a gene product that can be used for imaging. The microorganisms and cells provided herein can be used for expressing genes in vivo and in vitro. Exemplary proteins include reporter proteins (*E. coli* galactosidase, glucuronidase, xanthineguanine phosphoribosyl-transferase), proteins facilitating detection, i.e., a detectable protein or a protein capable of inducing a detectable signal, (e.g., luciferase, luminescent proteins, fluorescent proteins, ferritin, siderophore, transferrin receptor), proteins useful for tumor therapy (Pseudomonas A endotoxin, diphtheria toxin, p53, Arf, Bax, tumor necrosis factor alfa, HSV TK, *E. coli* purine nucleoside phosphorylase and derivatives thereof, cytosine deaminases, uracil, phosphoribosyltranspherase and fusions thereof (e.g. FCU1), angiostatin, endostatin, different cytokines) and many other proteins.

A variety of DNA sequences encoding proteins that can emit a detectable signal or that can catalyze a detectable reaction, such as luminescent or fluorescent proteins, are known and can be used in the microorganisms and cells and methods provided herein. An exemplary inducible promoter system can include arabinose induction of exogenous luciferase genes. Exemplary genes encoding light-emitting proteins include genes from bacterial luciferase from *Vibrio harveyi* (Belas et al., *Science* 218 (1982), 791-793) or *Vibrio fischerii* (Foran and Brown, *Nucleic acids Res.* 16: 177 (1988)), *Photorhabdus luminescens*, click beetle luciferase (Wood et al., *J. Biolumin. Chemilumin.* 4(1):289-301 (1989)), firefly luciferase (de Wet et al., *Mol. Cell. Biol.* 7: 725-737 (1987)), aequorin from *Aequorea victoria* (Prasher et al., *Biochem.* 26: 1326-1332 (1987)), *Renilla* luciferase from *Renilla renformis* (Lorenz et al., *PNAS USA* 88: 4438-4442 (1991)), green fluorescent protein (GFP) from *Aequorea victoria* (Prasher et al., *Gene* 111: 229-233 (1987)) or *Renilla* sea pansy, and other sea anemone and coral species, and variants thereof, including yellow fluorescent protein (YFP), orange fluorescent protein (OFP), cyan fluorescent protein (CFP), and blue fluorescent protein (BFP), red fluorescent protein (RFP) and far-red fluorescent protein from the corallimorph Discosoma (Matz et al., *Nature Biotechnology* 17: 969-973 (1999)), *Heteractis* reef coral and other sea anemone and coral species, as well as variants thereof including DsRed (Clontech, Palo Alto, Calif.), DsRed-T1 (Bevis and Glick, Nat. Biotechnol., 20: 83-87 (2002)), mPlum (Wang et al., PNAS USA. 101(48):16745-9 (2004)), HcRed1 and t-HcRed (Clontech, Palo Alto, Calif.), and near-infrared fluorescent proteins. Transformation and expression of these genes in microorganisms and cells can permit detection of microorganismal colonies, for example, using a low light imaging camera, such as an Argus-100 (Hamamatsu Photonics, Hamamatsu, Japan), Xenogen Imaging System (Alameda, Calif.), Berthold Night Owl (Berthold Technologies, Oak Ridge, Tenn.) or other low light imaging camera or fluorescence detector.

Fusion of the luxA and luxB genes can result in a fully functional luciferase protein (Escher et al., *PNAS* 86: 6528-6532 (1989)). This fusion gene (Fab$^2$) has introduced into a variety of microorganisms and cells followed by microorganismal infection and imaging based on luciferase expression. Fab$^2$ can be used in the microorganisms and cells and methods provided herein.

In some embodiments, luciferases expressed in bacteria can require exogenously added substrates such as decanal or coelenterazine for light emission. In other embodiments, microorganisms and cells can express a complete lux operon, which can include proteins that can provide luciferase substrates such as tetradecanal. For example, bacteria containing the complete lux operon sequence, when injected intraperitoneally, intramuscularly, or intravenously, allowed the visualization and localization of bacteria in live mice indicating that the luciferase light emission can penetrate the tissues and can be detected externally (Contag et al., *Mol. Microbiol.* 18 (1995), 593-603).

In other embodiments, the microorganism or cell can express a gene that can bind a detectable compound or that can form a product that can bind a detectable compound. A variety of gene products, such as peptides and proteins, that can specifically bind a detectable compound are known in the art, including receptors, metal binding proteins, ligand binding proteins, peptides, enzymes and antibodies. Any of a variety of detectable compounds can be used, and can be imaged by any of a variety of known imaging methods. Exemplary compounds include ligands for receptors and antigens for antibodies. The detectable compounds (diagnostic moiety) can be labeled according to the imaging method to be used. Exemplary imaging methods include any of a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography.

Labels appropriate for magnetic resonance imaging are known in the art, and include, for example, gadolinium chelates and iron oxides. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as $^{123}$I. Other exemplary radionuclides that can, be used, for example, as tracers for PET include $^{55}$Co, $^{67}$Ga, $^{68}$Ga, $^{60}$Cu (II), $^{67}$Cu(II), $^{57}$Ni, $^{52}$Fe and $^{18}$F. Examples of useful radionuclide-labeled agents are $^{64}$Cu-labeled engineered antibody fragment (Wu et al., *PNAS USA* 97: 8495-8500 (2002)), $^{64}$Cu-labeled somatostatin (Lewis et al., *J. Med. Chem.* 42: 1341-1347 (1999)), $^{64}$Cu-pyruvaldehyde-bis(N4-methylthiosemicarbazone)($^{64}$Cu-PTSM) (Adonai et al., PNAS USA 99: 3030-3035 (2002)), $^{52}$Fe-citrate (Leenders et al., *J. Neural. Transm. Suppl.* 43: 123-132 (1994)), $^{52}$Fe/$^{52m}$Mn-citrate (Calonder et al., *J. Neurochem.* 73: 2047-2055 (1999)) and $^{52}$Fe-labeled iron (III) hydroxide-sucrose complex (Beshara et al., *Br. J. Haematol.* 104: 288-295, 296-302 (1999)).

vi. More than One Gene Product

In some embodiments, microorganisms and cells can be modified to express two or more proteins using any of the methods provided herein. For example, a microorganism or cell can be modified to express a heterologous siderophore biosynthetic enzyme and a heterologous outer membrane protein. In another example, a microorganism or cell can be modified to express a heterologous receptor and over-express an exogenous ferritin-like compound. In yet another example, a microorganism or cell can be modified to express a recombinant outer membrane protein with a peptide insertion and a siderophore biosynthetic enzyme. In one example, a microorganism or cell can be modified to express a detectable protein and a therapeutic protein. In another embodiment, a microorganism or cell can be modified to express two or more gene products for detection or two or more therapeutic gene products.

When two or more exogenous genes are introduced, the genes can be regulated under the same or different regulatory sequences, and the genes can be inserted in the same or different regions of the microorganismal genome, in a single or a plurality of genetic manipulation steps. In another embodiment, the genes can be inserted in the same or different regions of one or more plasmids while others can be encoded on the microorganismal genome. In a different aspect, when two or more exogenous genes are introduced, the genes can be regulated under the same or different regulatory sequences, and the genes can be inserted in the same or different plasmid, in a single or a plurality of genetic manipulation steps. In some embodiments, one gene, such as a gene encoding a detectable gene product, can be under the control of a constitutive promoter, while a second gene, such as a gene encoding a therapeutic gene product, can be under the control of an inducible promoter. In yet another embodiment, a regulatory gene can be placed under the control of one promoter and another gene under control of a promoter that is controlled by the regulatory gene. For example, a T7 polymerase gene can be placed under the control of the arabinose inducible $P_{BAD}$ promoter and a gene of interest can be placed under the control of the T7 promoter resulting in a strong amplification of the arabinose induced signal. Methods for inserting two or genes into a microorganism or cell are known in the art and can be readily performed for a wide variety of microorganisms and cells using a wide variety of exogenous genes, regulatory sequences, and/or other nucleic acid sequences.

c. Inactivation of Genes

Methods to inactivate genes on a microorganismal chromosome are known to one skilled in the art. Microorganismal genes can be inactivated by replacing the chromosomal genes with disrupted derivatives containing antibiotic resistance cassettes or non-sense sequences in place of some or all of the corresponding coding regions. More than one gene can be inactivated (e.g., "knocked out") by these methods (Abdul-Tehrani et al. *J. Bacteriol.* 181(5): 1415-1428 (1999); Chen and Morse. *Microbiology* 145: 2967-2975 (1999); Waidner et al. *Infec. Immun.* 70(7): 3923-3929 (2002)). PCR analysis can be used to detect the resistance marker and confirm the mutagenesis (Bereswill et al. *Microbiology.* 144 (Pt 9): 2505-2516 (1998)). Conditional inactivation of bacterial genes using phage-based *E. coli* homologous recombination systems has been developed making it possible to subclone or modify DNA cloned into plasmids, BACs, or PACs without using restriction enzymes or DNA ligases (Liu et al. *Genome Res.* 13(3): 476-484 (2003)). Exemplary modifications to bacteria include, but are not limited to, inactivation of consensus sequences such as the 19-base pair DNA consensus sequence binding region of the Fur protein (5'-GATAAT-GATAATCATTATC-3'; SEQ ID NO: 46) that is found in the promoter region of many genes that are negatively regulated by iron, or inactivation of the msbB gene, which encodes a lipid acyl A transferase, that results in decreased virulence of the bacteria due to the synthesis of lipopolysaccharide (LPS) that lacks the myristic acid moiety of lipid A (Jung et al. *Enzyme Microb Technol.* 22(5):348-54 (1998) and U.S. Patent Application Publication No. 2005-0255088; see Example 8).

d. Insertion of Genes

Bacterial, viruses and eukaryotic cells can be modified such that a gene, or a portion thereof, is inserted into a chromosome.

Prokaryotic cells contain several classes of DNA insertion elements which move from place to place in the genome and mediate chromosome rearrangements. Similar elements exist in a wide variety of eukaryotic organisms (yeasts, insects, plants and vertebrates). At least five recombination mechanisms are known to cause chromosome changes: 1) general homologous, 2) site-specific reciprocal, 3) illegitimate, 4) DNA splicing, and 5) replicative; and the activities of DNA insertion elements and somatic rearrangement systems are subject to controls at several levels by specific regulatory systems, natural selection and connection to cell lineage (Shapiro JA. *Natl. Cancer Inst. Monogr.* 60: 87-110 (1982)).

In one example, a cassette containing a gene of interest, antibiotic resistance genes and two short direct repeat DNA sequences, one at each extremity of the cassette can be constructed. The bacteria containing the inserted gene of interest can be selected by antibiotic resistance. This methodology can be used to inactivate a gene and/or to introduce a gene of interest in a bacterial chromosome (Brans et al. *Appl. Environ. Microbiol.* 70(12): 7241-7250 (2004)).

DNA replacement systems have been established for engineering large fragment insertions into the chromosome of *E. coli.* A DNA replacement plasmid, such as pHybrid I, can be constructed based on a bacterial artificial chromosome (BAC) vector. Fragments of the *E. coli* genome can be introduced into the vector for homologous recombination. Additional markers can be introduced for double marker screening for recombinant clones (Rong et al. *Gene.* 336(1): 73-80 (2004)).

In one embodiment, bacteria can be transformed with a vehicle including, but not limited to, plasmids, phages, cosmids, phagemids, etc., carrying one or more genes, or portions thereof, that remain on the plasmids and are expressed. Selection of delivery vehicles, modification of vehicles to insert genes and methods of introducing vehicles into various microorganisms and cells are well known in the art, such as described by Sambrook et al. (Molecular Cloning: A Laboratory Manual. $2^{nd}$ ed. Cold Spring Harbor Laboratory Press, New York, N.Y. 1989; Current Protocols in Molecular Biology. Ed. Ausubel et al. John Wiley & Sons, Inc. Cambridge, Mass., 1995).

Viral genomes can be cloned into a bacterial artificial chromosome (BAC) vector. The BAC clone has been used for rapidly and precisely modifying *E. coli* by efficient homologous recombination. This method can be further modified so that any kind of cDNA can be rapidly inserted into a site that has been artificially introduced into BAC (Kanda et al. *J. Virol.* 78(13): 7004-7015 (2004)).

The large capacity of vaccinia virus (VAC) for added DNA, cytoplasmic expression and broad host range makes it a popular choice for gene delivery. A bacterial artificial chromosome (BAC) containing the entire VAC genome can be engineered in *E. coli* by homologous recombination using bacteriophage lambda-encoded enzymes; and the engineered VAC genomes can then be used to produce clonally pure recombinant viruses in mammalian cells without the need for plaque purification (Domi and Moss. *Nat. Methods.* 2(2): 95-97 (2005)).

e. Screening for Above Characteristics

Modified microorganisms and cells can be screened for any desired characteristics, including the characteristics described herein such as attenuated pathogenicity, reduced toxicity, preferential accumulation in tumor, increased ability to capture iron, increased ability to transport iron, increased ability to store iron, increased or decreased replication competence, ability to express or over-express exogenous proteins, ability to over-express endogenous proteins, inactivation of genes and combinations thereof. For example, the microorganisms and cells can be screened for expression of one or more detectable genes, including genes that can be used for imaging, or for expression of one or more genes that bind peptides, proteins, antibodies and/or nanostructures, which are conjugated to detectable moieties and/or therapeutic agents using any of the methods provided herein.

Any of a variety of known methods for screening for such characteristics can be performed, as demonstrated in the Examples provided herein. One exemplary method for screening for desired characteristics includes, but is not limited to, monitoring growth, replication and/or gene expression (including expression of an exogenous gene) in cell culture or other in vitro medium. The cell culture can be from any organism, and from any tissue source, and can include tumorous tissues. Other exemplary methods for screening for desired characteristics include, but are not limited to, administering a microorganism or cell to an animal, including non-human animals such as a rat, a mouse, monkey or ape and, optionally, also including humans, and monitoring the microorganism, the tumor and/or the animal; monitoring can be performed by in vivo imaging of the and/or the tumor (e.g., low light imaging, fluorescence imaging, magnetic resonance imaging, ultrasonic tumor imaging, PET, CT, SPECT, etc.), external monitoring of the tumor (e.g., external measurement of tumor size), monitoring the animal (e.g., monitoring animal weight, blood panel, spleen size, or liver size), or combination thereof. Other exemplary methods for screening for desired characteristics include, but are not limited to, harvesting a non-human animal for the effects and location of the microorganism or cell and expression by the microorganism or cell including, but not limited to, methods such as harvesting a variety of organs including a tumor to determine presence of the microorganism or cell and/or gene expression by the microorganism or cell in the organs or tumor, harvesting of organs associated with microorganismal clearance such as the spleen or liver, harvesting the tumor to determine tumor size and viability of tumor cells, or a combination thereof. Such screening and monitoring methods can be used in any of a variety of combinations, as is known in art. In one embodiment, a microorganism or cell can be screened by administering the microorganism or cell to an animal such as a non-human animal or a human, followed by monitoring by in vivo imaging. In another embodiment, a microorganism or cell can be screened by administering the microorganism or cell to an animal, such as, for example, a non-human animal, monitoring by in vivo imaging, and then harvesting the animal. Thus, provided herein are methods for screening a microorganism or cell for desired characteristics by administering the microorganism or cell to an animal such as an animal with a tumor, and monitoring the animal, tumor (if present), and/or microorganism or cell in the animal for one or more characteristics. Also provided herein are methods for screening a microorganism or cell for desired characteristics by administering the microorganism or cell to a non-human animal such as a non-human animal with a tumor, harvesting the animal, and assaying the animal's organs and/or tumor (if present) for one or more characteristics.

Provided herein are methods for screening a microorganism or cell for attenuated pathogenicity or reduced toxicity, where the pathogenicity or toxicity can be determined by a variety of techniques, including, but not limited to, assessing the health state of the subject, measuring the body weight of a subject, blood or urine analysis of a subject, and monitoring tissue distribution of the microorganism or cell within the subject; such techniques can be performed on a living subject in vivo (e.g., via surgery), or can be performed post mortem. Methods also can include the ability of the microorganisms to lyse cells or cause cell death, which can be determined in vivo or in vitro.

When a subject drops below a threshold body weight, the microorganism or cell can be considered pathogenic to the subject. Exemplary thresholds can be a drop of about 5% or more, a drop of about 10% or more, or a drop of about 15% or more in body weight relative to a reference. A body weight reference can be selected from any of a variety of references used in the art; for example, a body weight reference can be the weight of the subject prior to administration of the microorganism, the body weight reference can be a control subject having the same condition as the test subject (e.g., normal or tumor-injected), where the change in weight of the control is compared to the change in weight of the test subject for the time period after administration of the microorganism.

Blood or urine analysis of the subject can indicate level of immune response, level of toxins in the subject, or other levels of stress to cells, tissues or organs of the subject such as kidneys, pancreas, liver and spleen. Levels increased above established threshold levels can indicate pathogenicity of the microorganism or cell to the subject. Threshold levels of components of blood or urine for indicating microorganismal pathogenicity are well known in the art, and any such thresholds can be selected herein according to the desired tolerance of pathogenicity or toxicity of the microorganism.

Tissue distribution of a microorganism or cell in a subject can indicate pathogenicity or toxicity of the microorganism. In one embodiment, tissue distribution of a microorganism or cell that is not pathogenic or toxic can be mostly in tumors or metastasis relative to other tissues or organs. Microorganisms and cells located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than accumulation of the microorganism or cell in a non-tumorigenic organ or tissue.

Provided herein are methods for screening a microorganism or cell for tissue distribution or accumulation, where the tissue distribution can be determined by a variety of techniques, including, but not limited to, harvesting a non-human subject, in vivo imaging a detectable moiety in the subject. Harvesting can be accomplished by euthanizing the non-human subject, and determining the accumulation of microorganisms and cells in tumor and, optionally, the accumulation in one or more additional tissues or organs. The accumulation can be determined by any of a variety of methods, including, but not limited to, detecting gene products such as detectable gene products (e.g., GFP or beta galactosidase), detecting contrast agents (e.g., iron, gadolinium, gold or gallium), histological or microscopic evaluation of tissue, organ or tumor samples, or measuring the number of plaque or colony forming units present in a tissue, organ or tumor sample. In one embodiment, the desired amount of tissue distribution of a microorganism or cell can be mostly in tumor relative to other tissues or organs. Microorganisms and cells located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than accumulation of the microorganism or cell in a non-tumorigenic organ or tissue.

Also provided herein are methods of screening for the ability of the microorganisms to lyse cells or cause cell death, which can be determined in vivo or in vitro.

Also provided herein are methods for determining increased or decreased replication competence, by monitoring the speed of replication of the microorganisms and cells. Such measurements can be performed in vivo or in vitro. For example, the speed of replication in a cell or bacterial culture can be used to determine replication competence of a microorganism. In another example, the speed of replication in a tissue, organ or tumor in a subject can be used to measure replication competence. In some embodiments, decreased replication competence in non-tumor tissues and organs can be the characteristic to be selected in a screen. In other embodiments, increased replication competence in tumors can be the characteristic to be selected in a screen.

Also provided herein are methods for determining the ability of a microorganism or cell to express genes, such as an endogenous gene or an exogenous gene. Such methods can be performed in vivo or in vitro. For example, the microorganisms can be screened on selective plates for the ability to express a gene that permits survival of the microorganism, increased capacity to capture, transport and/or store iron, or permits the microorganism or cell to provide a detectable signal, such as luciferase. Such methods also can be performed in vitro, where expression can be determined, for example, following harvesting tissues, organs or tumors a non-human subject or by in vivo imaging of a subject.

Also provided herein are methods for screening a microorganism or cell that has two or more characteristics provided herein, including screening for attenuated pathogenicity, reduced toxicity, preferential accumulation in tumor, increased ability to capture iron, increased ability to transport iron, increased ability to store iron, increased immunogenicity, increased or decreased replication competence, inactivation of genes, ability to express or over-express endogenous or exogenous proteins, or a combination thereof. A single monitoring technique, such as in vivo imaging, can be used to verify two or more characteristics, or a variety of different monitoring techniques can be used, as can be determined by one skilled in the art according to the selected characteristics and according to the monitoring techniques used.

E. MICROORGANISM AND CELL CHARACTERISTICS AND STRAINS

The microorganisms and cells provided herein and used in the methods herein can be, for example, non-pathogenic or attenuated and replication competent. In one embodiment, the microorganism or cell can be lytic and/or immunogenic. Modifications of the microorganisms and cells provided herein can result in a modification of microorganismal characteristics, including those provided herein such as pathogenicity, toxicity, ability to preferentially accumulate in tumor, ability to lyse cells or cause cell death, ability to express or over-express and, optionally, secrete an exogenous polypeptide, ability to over-express and, optionally, secrete an endogenous polypeptide, increased ability to capture iron, increased ability to transport iron, increased ability to store iron, and replication competence.

1. General Characteristics
a. Attenuated

The microbes used in the methods provided herein are typically attenuated. Attenuated microbes have a decreased capacity to cause disease, such as septic shock, in a host. The decreased capacity can result from any of a variety of different modifications to the ability of a microbe to be pathogenic. For example, a microbe can have reduced toxicity, reduced ability to accumulate in non-tumorous organs or tissue, or reduced ability to replicate compared to the non-attenuated form thereof. The attenuated microbes provided herein, however, retain at least some capacity to replicate and to accumulate iron or other compounds based on the recombinant genes introduced into the genome or carried on a plasmid, thereby imaging the tumor or causing cell death to tumor cells.

i. Reduced Toxicity

Microbes can be toxic to their hosts by manufacturing one or more compounds, or scavenging essential nutrients from the host environment, that worsen the health condition of the host. Toxicity to the host can be manifested in any of a variety of manners, including, for example, septic shock. The microbes provided herein can have a reduced toxicity to the host compared to the wild-type strain of microorganism. The reduced toxicity of a microbe of the present methods and compositions can range from a toxicity in which the host experiences no toxic effects, to a toxicity in which the host does not typically die from the toxic effects of the microbes. In some embodiments, the microbes are of a reduced toxicity such that a host typically experiences no significant long-term effects from the presence of the microbes in the host, beyond any affect on tumorous, metastatic or necrotic organs or tissues. For example, the reduced toxicity can be measured as an unintentional decline in body weight of about 5% or less for the host after administration of the microbes. In other examples, the microbe has 5%, 10%, 15%, 20%, 25%, 30%, 35%, 40%, 45%, 50%, 55%, 60%, 65%, 70%, 75%, 80%, 85%, 90%, 95% less toxicity than wild-type microbe, or no toxicity to the host.

ii. Accumulate in Immunoprivileged Cells and Tissues, Such as Tumor, not Substantially in Other Organs Microbes can accumulate in any of a variety of tissues and organs of the host. Accumulation can be evenly distributed over the entire host organism, or can be concentrated in one or a few organs or tissues. The microbes provided herein can accumulate in targeted tissues, such as immunoprivileged cells and tissues, such as tumors and also metastases. In other embodiments the microbes provided herein exhibit accumulation in immunoprivileged cells and tissues (such as tumor cells) that is equal to or greater than the accumulation in any other particular organ or tissue. For example, the microbes provided herein can demonstrate an accumulation in immunoprivileged cells and tissues, such as tumor cells that is at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the accumulation in any other particular organ or tissue.

In some embodiments, a microbe can accumulate in targeted tissues and cells, such as immunoprivileged cells and tissues, such as tumor cells, without accumulating in one or more selected tissues or organs. For example, a microbe can accumulate in tumors without accumulating in the brain. In another example, a microbe can accumulate in tumors without accumulating in neural cells. In another example, a microbe can accumulate in tumors without accumulating in ovaries. In another example, a microbe can accumulate in tumors without accumulating in the blood. In another example, a microbe can accumulate in tumors without accumulating in the heart. In another example, a microbe can accumulate in tumors without accumulating in the bladder. In another example, a microbe can accumulate in tumors without accumulating in testes. In another example, a microbe can accumulate in tumors without accumulating in the spleen. In another example, a microbe can accumulate in tumors without accumulating in the lungs. In another example, a microbe can accumulate in tumors without accumulating in the pancreas.

One skilled in the art can determine the desired capability for the microbes to selectively accumulate in targeted tissue or cells, such as in a immunoprivileged cells and tissues, such as tumor, rather than non-target organs or tissues, according to a variety of factors known in the art, including, but not limited to, toxicity of the microbes, dosage, tumor to be treated, immunocompetence of host, and disease state of the host.

b. Replication Competent

The microorganisms and cells provided herein can be replication competent. In a variety of bacterial systems, the administered microorganism or cell is rendered replication incompetent to limit pathogenicity risk to the host. While replication incompetence can protect the host from the microorganism, that also is limits the ability of the microorganism or cell to infect and kill tumors, and typically results in only a short-lived effect. In contrast, the microorganisms and cells provided herein can be attenuated but replication competent, resulting in low toxicity to the host and accumulation mainly, or solely, in tumors. Thus, the microorganisms and cells provided herein can be replication competent without creating a pathogenicity risk to the host.

Attenuation of the microorganisms and cells provided herein can include, but not be limited to, reducing the replication competence of the microorganism. For example, a microorganism or cell can be modified to decrease or eliminate an activity related to replication, such as a transcriptional activator or a repressor that regulates replication in the microorganism. In an example, a microorganism or cell (such as a bacterium), can carry plasmids, such as pBR322 and ColE1, that are modified to affect replication and maintenance of the vector in bacteria based on the early characterization of the molecule, including its nucleotide sequence, replication and maintenance mechanisms, and determination of its coding regions (Balbas and Bolivar. *Methods Mol. Biol.* 267: 77-90 (2004); Grabherr and Bayer. *Trends Biotechnol.* 20(6): 257-260 (2002); Jung and Lee. *Mol. Biol. Rep.* 22(2-3): 195-200 (1995-996)).

2. Bacteria

Bacteria can also be used in the methods provided herein. Any of a variety of bacteria possessing the desired characteristics can be used. In one embodiment, aerobic bacteria can be used. In another embodiment, anaerobic bacteria can be used. Exemplary bacteria provided herein include, for example, *Abiotrophia, Acetanaerobacterium, Acetitomaculum, Acetivibrio, Acetoanaerobium, Acetobacter, Acetobacterium, Acetofilamentum, Acetogenium, Acetohalobium, Acetomicrobium, Acetonema, Acetothermus, Acholeplasma, Achromatium, Achromobacter, Acidaminobacter, Acidaminococcus, Acidimicrobium, Acidiphilium, Acidisphaera, Acidithiobacillus, Acidobacterium, Acidocella, Acidomonas, Acidothermus, Acidovorax, Acinetobacter, Acrocarpospora, Actinoalloteichus, Actinobacillus, Actinobaculum, Actinobispora, Actinocorallia, Actinokineospora, Actinomadura, Actinomyces, Actinoplanes, Actinopolymorpha, Actinopolyspora, Actinopycnidium, Actinosporangium, Actinosynnema, Adhaeribacter, Advenella, Aegyptianella, Aequorivita, Aeriscardovia, Aerococcus, Aeromicrobium, Aeromonas, Aestuariibacter, Afipia, Agarivorans, Agitococcus, Agreia, Agrobacterium, Agrococcus, Agromonas, Agromyces, Ahrensia, Akkermansia, Albibacter, Albidovulum, Alcaligenes, Alcanivorax, Algibacter, Algicola, Algoriphagus, Alicycliphilus, Alicyclobacillus, Alishewanella, Alistipes, Alkalibacillus, Alkalibacter, Alkalibacterium, Alkaliflexus, Alkalilimnicola, Alkaliphilus, Alkalispirillum, Alkanindiges, Allisonella, Allochromatium, Allofustis, Alloiococcus, Allomonas, Allorhizobium, Alteroccocus, Alteromonas, Alysiella, Amaricoccus, Aminobacter, Aminobacterium, Aminomonas, Ammonifex, Ammoniphilus, Amoebobacter, Amorphosphorangium, Amphibacillus, Ampullariella, Amycolata, Amycolatopsis, Anaeroarcus, Anaerobacter, Anaerobaculum, Anaerobiospirillum, Anaerobranca, Anaerococcus, Anaerofilum, Anaerofustis, Anaeroglobus, Anaerolinea, Anaeromusa, Anaeromyxobacter, Anaerophaga, Anaeroplasma, Anaerorhabdus, Anaerosinus, Anaerostipes, Anaerotruncus, Anaerovibrio, Anaerovorax, Anaplasma, Ancalochloris, Ancalomicrobium, Ancylobacter, Aneurinibacillus, Angiococcus, Angulomicrobium, Anoxybacillus, Anoxynatronum, Antarctobacter, Aquabacter, Aquabacterium, Aquamicrobium, Aquaspirillum, Aquicella, Aquifex, Aquiflexum, Aquimarina, Aquimonas, Arachnia, Arcanobacterium, Archangium, Arcicella, Arcobacter, Arenibacter, Arhodomonas, Arsenicicoccus, Arsenophonus, Arthrobacter, Asaia, Asanoa, Asteroleplasma, Asticcacaulis, Atopobacter, Atopobium, Atopococcus, Atopostipes, Aurantimonas, Aureobacterium, Avibacterium, Azoarcus, Azomonas, Azomonotrichon, Azonexus, Azorhizobium, Azorhizophilus, Azospira, Azospirillum, Azotobacter, Azovibrio, Bacillus, Bacterionema, Bacteriovorax, Bacteroides, Bactoderma, Balnearium, Balneatrix, Balneimonas, Bartonella, Bdellovibrio, Beggiatoa, Beijerinckia, Belliella, Beneckea, Bergeriella, Bergeyella, Beutenbergia, Bifidobacterium, Bilophila, Bizionia, Blastobacter, Blastochloris, Blastococcus, Blastomonas, Blastopirellula, Blattabacterium, Bogoriella, Bordetella, Borrelia, Bosea, Brachybacterium, Brachymonas, Brachyspira, Brackiella, Bradyrhizobium, Branhamella, Brenneria, Brevibacillus, Brevibacterium, Brevinema, Brevundimonas, Brochothrix, Brucella, Brumimicrobium, Bryantella, Buchnera, Budvicia, Bulleidia, Burkholderia, Buttiauxella, Butyrivibrio, Caedibacter, Caenibacterium, Caldanaerobacter, Calderobacterium, Caldicellulosiruptor, Caldilinea, Caldimonas, Caldithrix, Caloramator, Caloranaerobacter, Calymmatobacterium, Caminibacter, Caminicella, Campylobacter, Capnocytophaga, Capsularis, Carbophilus, Carboxydibrachium, Carboxydocella, Carboxydothermus, Cardiobacterium, Carnimonas, Carnobacterium, Caryophanon, Caseobacter, Catellatospora, Catellibacterium, Catenibacterium, Catenococcus, Catenuloplanes, Catonella, Caulobacter, Cedecea, Cellulomonas, Cellulophaga, Cellulosimicrobium, Cellvibrio, Centipeda, Cerasibacillus, Cetobacterium, Chainia, Chelatobacter, Chelatococcus, Chitinibacter, Chitinimonas, Chitinophaga, Chlamydia, Chlamydophila, Chlorobaculum, Chlorobium, Chloroflexus, Chloroherpeton, Chloronema, Chondromyces, Chromatium, Chromobacterium, Chromohalobacter, Chryseobacterium, Chryseomonas, Chrysiogenes, Citricoccus, Citrobacter, Clavibacter, Clevelandina, Clostridium, Cobetia, Coenonia, Collimonas, Collinsella, Colwellia, Comamonas, Conchiformibius, Conexibacter, Conglomeromonas, Coprobacillus, Coprococcus, Coprothermobacter, Coriobacterium, Corynebacterium, Couchioplanes, Cowdria, Coxiella, Craurococcus, Crenothrix, Cristispira, Croceibacter, Crocinitomix, Crossiella, Cryobacterium, Cryomorpha, Cryptanaerobacter, Cryptobacterium, Cryptosporangium, Cupriavidus, Curtobacterium, Curvibacter, Cyclobacterium, Cycloclasticus, Cystobacter, Cytophaga, Dactylosporangium, Dechloromonas, Dechlorosoma, Deferribacter, Defluvibacter, Defluvicoccus, Dehalobacter, Dehalospirillum, Deinobacter, Deinococcus, Deleya, Deiltia, Demetria, Dendrosporobacter, Denitrobacterium, Denitrovibrio, Dermabacter, Dermacoccus, Dermatophilus, Derxia, Desemzia, Desulfacinum, Desulfatibacillum, Desulfitobacterium, Desulfobacca, Desulfobacter, Desulfobacterium, Desulfobacula, Desulfobulbus, Desulfocapsa, Desulfocella, Desulfococcus, Desulfofaba, Desulfofrigus, Desulfofustis, Desulfohalobium, Desulfomicrobium, Desulfomonas, Desulfomonile, Desulfomusa, Desulfonatronovibrio, Desulfonatronum, Desulfonauticus, Desulfonema, Desulfonispora, Desulforegula, Desulforhabdus, Desulforhopalus, Desulfosarcina, Desulfospira, Desulfosporosinus, Desulfotalea, Desulfotignum, Desulfotomaculum, Desulfovibrio, Desulfovirga, Desulfurella, Desulfurobacterium, Desulfuromonas, Desulfuromusa, Dethiosulfovibrio, Devosia, Dialister, Diaphorobacter, Dichelobacter, Dichotomicrobium, Dickeya, Dictyoglomus, Dietzia, Dinoroseobacter, Diplocalyx, Dolosicoccus, Dolosigranulum, Dorea, Duganella, Dyadobacter, Dyella, Dysgonomonas, Ectothiorhodospira, Edwardsiella, Eggerthella, Ehrlichia, Eikenella, Elizabethkingia, Elytrosporangium, Empedobacter, Enhydrobacter, Enhygromyxa, Ensifer, Enterobacter, Enterococcus, Enterovibrio, Entomoplasma, Eperythrozoon, Eremococcus, Erwinia, Erysipelothrix, Erythrobacter, Erythromicrobium, Erythromonas, Escherichia, Eubacterium, Ewingella, Excellospora, Exiguobacterium, Facklamia, Faecalibacterium, Faenia, Falcivibrio, Fastidiosipila, Ferribacterium, Ferrimonas, Fervidobacterium, Fibrobacter, Filibacter, Filifactor, Filobacillus, Filomi-

*crobium, Finegoldia, Flammeovirga, Flavimonas, Flavobacterium, Flectobacillus, Flexibacter, Flexistipes, Flexithrix, Fluoribacter, Fluviicola, Formivibrio, Formosa, Francisella, Frankia, Frateuria, Friedmanniella, Frigoribacterium, Fulvimarina, Fulvimonas, Fundibacter, Fusibacter, Fusobacterium, Gaetbulibacter, Gallibacterium, Gallicola, Gallionella, Garciella, Gardnerella, Gelidibacter, Gelria, Gemella, Gemmata, Gemmatimonas, Gemmiger, Gemmobacter, Geobacillus, Geobacter, Geodermatophilus, Geopsychrobacter, Georgenia, Geothermobacter, Geothrix, Geotoga, Geovibrio, Gillisia, Glaciecola, Globicatella, Gluconacetobacter, Gluconobacter, Glycomyces, Gordonia, Gracilibacillus, Grahamella, Gramella, Granulicatella, Grimontia, Guggenheimella, Gulosibacter, Haemobartonella, Haemophilus, Hafnia, Hahella, Halanaerobacter, Halanaerobium, Haliangium, Haliscomenobacter, Hallella, Halobacillus, Halobacteroides, Halocella, Halochromatium, Haloincola, Halomonas, Halonatronum, Halorhodospira, Halospirulina, Halothermothrix, Halothiobacillus, Halovibrio, Helcococcus, Heliobacillus, Helicobacter, Heliobacterium, Heliophilum, Heliorestis, Heliothrix, Herbaspirillum, Herbidospora, Herpetosiphon, Hespellia, Hippea, Hirschia, Histophilus, Hoeflea, Holdemania, Hollandina, Holophaga, Holospora, Hongia, Hongiella, Hydrocarboniphaga, Hydrogenimonas, Hydrogenivirga, Hydrogenobacter, Hydrogenobaculum, Hydrogenophaga, Hydrogenophilus, Hydrogenothermus, Hydrogenovibrio, Hylemonella, Hymenobacter, Hyphomicrobium, Hyphomonas, Ideonella, Idiomarina, Ignavigranum, Ilyobacter, Inquilinus, Intrasporangium, Iodobacter, Isobaculum, Isochromatium, Isoptericola, Isosphaera, Janibacter, Jannaschia, Janthinobacterium, Jeotgalibacillus, Jeotgalicoccus, Jiangella, Johnsonella, Jonesia, Kaistella, Kaistia, Kangiella, Kerstersia, Ketogulonicigenium, Kibdelosporangium, Kineococcus, Kineosphaera, Kineosporia, Kingella, Kitasatoa, Kitasatospora, Klebsiella, Kluyvera, Knoellia, Kocuria, Kordia, Kordiimonas, Koserella, Kozakia, Kribbella, Kurthia, Kutzneria, Kytococcus, Labrys, Laceyella, Lachnobacterium, Lachnospira, Lacinutrix, Lactobacillus, Lactococcus, Lactosphaera, Lactovum, Lamprobacter, Lamprocystis, Lampropedia, Laribacter, Lautropia, Lawsonia, Lebetimonas, Lechevalieria, Leclercia, Leeuwenhoekiella, Legionella, Leifsonia, Leisingera, Leminorella, Lentibacillus, Lentisphaera, Lentzea, Leptonema, Leptospira, Leptospirillum, Leptothrix, Leptotrichia, Leucobacter, Leuconostoc, Leucothrix, Levinea, Lewinella, Limnobacter, Listeria, Listonella, Loktanella, Lonepinella, Longispora, Lucibacterium, Luteimonas, Luteococcus, Lysobacter, Lyticum, Macrococcus, Macromonas, Magnetospirillum, Mahella, Malikia, Malonomonas, Mannheimia, Maribacter, Maricaulis, Marichromatium, Marinibacillus, Marinicola, Marinilabilia, Marinilactibacillus, Marinithermus, Marinitoga, Marinobacter, Marinobacterium, Marinococcus, Marinomonas, Marinospirillum, Marmoricola, Martelella, Massilia, Megamonas, Megasphaera, Meiothermus, Melissococcus, Melittangium, Meniscus, Mesonia, Mesophilobacter, Mesoplasma, Mesorhizobium, Methylarcula, Methylobacillus, Methylobacter, Methylobacterium, Methylocaldum, Methylocapsa, Methylocella, Methylococcus, Methylocystis, Methylohalobius, Methylomicrobium, Methylomonas, Methylophaga, Methylophilus, Methylopila, Methylorhabdus, Methylosarcina, Methylosinus, Methylosphaera, Methylothermus, Methylovorus, Micavibrio, Microbacterium, Microbispora, Microbulbifer, Microcella, Micrococcus, Microcyclus, Microellobosporia, Microlunatus, Micromonas, Micromonospora, Micropolyspora, Micropruina, Microscilla, Microsphaera, Microtetraspora, Microvirga, Microvirgula, Mitsuaria, Mitsuokella, Mobiluncus, Modestobacter, Moellerella, Mogibacterium, Moorella, Moraxella, Morganella, Moritella, Morococcus, Mucispirillum, Muricauda, Muricoccus, Myceligenerans, Mycetocola, Mycobacterium, Mycoplana, Mycoplasma, Myroides, Myxococcus, Nakamurella, Nannocystis, Natroniella, Natronincola, Nautilia, Naxibacter, Neisseria, Neochlamydia, Neorickettsia, Neptunomonas, Nereida, Nesterenkonia, Nevskia, Nicoletella, Nitratifractor, Nitratireductor, Nitratiruptor, Nitrobacter, Nitrococcus, Nitrosococcus, Nitrosolobus, Nitrosomonas, Nitrosospira, Nitrospina, Nitrospira, Nocardia, Nocardioides, Nocardiopsis, Nonomuraea, Novosphingobium, Obesumbacterium, Oceanibulbus, Oceanicaulis, Oceanicola, Oceanimonas, Oceanisphaera, Oceanithermus, Oceanobacillus, Oceanobacter, Oceanospirillum, Ochrobactrum, Octadecabacter, Oenococcus, Oerskovia, Okibacterium, Oleiphilus, Oleispira, Oligella, Oligotropha, Olleya, Olsenella, Opitutus, Orenia, Oribacterium, Oribaculum, Orientia, Ornithinicoccus, Ornithinimicrobium, Ornithobacterium, Oscillochloris, Oscillospira, Ottowia, Owenweeksia, Oxalicibacterium, Oxalobacter, Oxalophagus, Oxobacter, Paenibacillus, Pandoraea, Pannonibacter, Pantoea, Papillibacter, Parachlamydia, Paracoccus, Paracraurococcus, Paralactobacillus, Paraliobacillus, Parascardovia, Parasporobacterium, Parvibaculum, Parvularcula, Pasteurella, Pasteuria, Paucibacter, Paucimonas, Pectinatus, Pectobacterium, Pediococcus, Pedobacter, Pedomicrobium, Pelczaria, Pelistega, Pelobacter, Pelodictyon, Pelospora, Pelotomaculum, Peptococcus, Peptoniphilus, Peptostreptococcus, Peredibacter, Persephonella, Persicobacter, Petrimonas, Petrobacter, Petrotoga, Pfennigia, Phaeospirillum, Phascolarctobacterium, Phenylobacterium, Phocoenobacter, Photobacterium, Photorhabdus, Phyllobacterium, Pibocella, Pigmentiphaga, Pilimelia, Pillotina, Pimelobacter, Pirella, Pirellula, Piscirickettsia, Planctomyces, Planifilum, Planktothricoides, Planobispora, Planococcus, Planomicrobium, Planomonospora, Planopolyspora, Planotetraspora, Plantibacter, Pleomorphomonas, Plesiocystis, Plesiomonas, Polaribacter, Polaromonas, Polyangium, Polynucleobacter, Pontibacillus, Porphyrobacter, Porphyromonas, Pragia, Prauserella, Prevotella, Prochlorococcus, Prochloron, Prochlorothrix, Prolinoborus, Promicromonospora, Propionibacter, Propionibacterium, Propionicimonas, Propioniferax, Propionigenium, Propionimicrobium, Propionispira, Propionispora, Propionivibrio, Prosthecobacter, Prosthecochloris, Prosthecomicrobium, Proteus, Protomonas, Providencia, Pseudaminobacter, Pseudoalteromonas, Pseudoamycolata, Pseudobutyrivibrio, Pseudocaedibacter, Pseudoclavibacter, Pseudomonas, Pseudonocardia, Pseudoramibacter, Pseudorhodobacter, Pseudospirillum, Pseudovibrio, Pseudoxanthomonas, Psychrobacter, Psychroflexus, Psychromonas, Psychroserpens, Pusillimonas, Quadricoccus, Quadrisphaera, Quinella, Rahnella, Ralstonia, Ramlibacter, Raoultella, Rarobacter, Rathayibacter, Reichenbachia, Reinekea, Renibacterium, Rhabdochromatium, Rheinheimera, Rhizobacter, Rhizobium, Rhizomonas, Rhodanobacter, Rhodobaca, Rhodobacter, Rhodobium, Rhodoblastus, Rhodocista, Rhodococcus, Rhodocyclus, Rhodoferax, Rhodoglobus, Rhodomicrobium, Rhodopila, Rhodopirellula, Rhodoplanes, Rhodopseudomonas, Rhodospira, Rhodospirillum, Rhodothalassium, Rhodothermus, Rhodovarius, Rhodovibrio, Rhodovulum, Rickettsia, Rickettsiella, Riemerella, Rikenella, Robiginitalea, Rochalimaea, Roseateles, Roseburia, Roseibium, Roseicyclus, Roseiflexus, Roseinatronobacter, Roseisalinus, Roseivirga, Roseivivax, Roseobacter, Roseococcus, Roseomonas, Roseospira, Roseospirillum, Roseovarius,*

*Rothia, Rubrimonas, Rubritepida, Rubrivivax, Rubrobacter, Ruegeria, Rugamonas, Ruminobacter, Ruminococcus, Runella, Saccharibacter, Saccharobacter, Saccharococcus, Saccharomonospora, Saccharophagus, Saccharopolyspora, Saccharospirillum, Saccharothrix, Sagittula, Salana, Salegentibacter, Salibacillus, Salinibacillus, Salinibacter, Salinibacterium, Salinicoccus, Salinimonas, Salinisphaera, Salinispora, Salinivibrio, Salipiger, Salmonella, Samsonia, Sandaracinobacter, Sanguibacter, Saprospira, Sarcina, Sarcobium, Scardovia, Schineria, Schlegelella, Schwartzia, Sebaldella, Sedimentibacter, Segniliparus, Seinonella, Sejongia, Selenihalanaerobacter, Selenomonas, Seliberia, Serinicoccus, Serpens, Serpula, Serpulina, Serratia, Shewanella, Shigella, Shuttleworthia, Silanimonas, Silicibacter, Simkania, Simonsiella, Sinorhizobium, Skermanella, Skermania, Slackia, Smithella, Sneathia, Sodalis, Soehngenia, Solirubrobacter, Solobacterium, Sphaerobacter, Sphaerotilus, Sphingobacterium, Sphingobium, Sphingomonas, Sphingopyxis, Spirilliplanes, Spirillospora, Spirillum, Spirochaeta, Spiroplasma, Spirosoma, Sporanaerobacter, Sporichthya, Sporobacter, Sporobacterium, Sporocytophaga, Sporohalobacter, Sporolactobacillus, Sporomusa, Sporosarcina, Sporotomaculum, Stackebrandtia, Staleya, Stanierella, Staphylococcus, Stappia, Starkeya, Stella, Stenotrophomonas, Sterolibacterium, Stibiobacter, Stigmatella, Stomatococcus, Streptacidiphilus, Streptoalloteichus, Streptobacillus, Streptococcus, Streptomonospora, Streptomyces, Streptosporangium, Streptoverticillium, Subdoligranulum, Subsaxibacter, Subsaximicrobium, Subtercola, Succiniclasticum, Succinimonas, Succinispira, Succinivibrio, Sulfitobacter, Sulfobacillus, Sulfuricurvum, Sulfurihydrogenibium, Sulfurimonas, Sulfurospirillum, Sulfurovum, Sutterella, Suttonella, Swaminathania, Symbiobacterium, Symbiotes, Synergistes, Syntrophobacter, Syntrophobotulus, Syntrophococcus, Syntrophomonas, Syntrophosphora, Syntrophothermus, Syntrophus, Tannerella, Tatlockia, Tatumella, Taylorella, Tectibacter, Teichococcus, Telluria, Tenacibaculum, Tenuibacillus, Tepidibacter, Tepidimonas, Tepidiphilus, Terasakiella, Teredinibacter, Terrabacter, Terracoccus, Tessaracoccus, Tetragenococcus, Tetrasphaera, Tetrathiobacter, Thalassobacillus, Thalassobacter, Thalassolituus, Thalassomonas, Thalassospira, Thauera, Thermacetogenium, Thermaerobacter, Thermanaeromonas, Thermanaerovibrio, Thermicanus, Thermincola, Thermithiobacillus, Thermoactinomyces, Thermoanaerobacter, Thermoanaerobacterium, Thermoanaerobium, Thermobacillus, Thermobacteroides, Thermobifida, Thermobispora, Thermobrachium, Thermochromatium, Thermocrinis, Thermocrispum, Thermodesulfatator, Thermodesulfobacterium, Thermodesulfobium, Thermodesulforhabdus, Thermodesulfovibrio, Thermoflavimicrobium, Thermohalobacter, Thermohydrogenium, Thermoleophilum, Thermomicrobium, Thermomonas, Thermomonospora, Thermonema, Thermopolyspora, Thermosinus, Thermosipho, Thermosyntropha, Thermoterrabacterium, Thermothrix, Thermotoga, Thermovenabulum, Thermovibrio, Thermus, Thioalkalicoccus, Thioalkalimicrobium, Thioalkalispira, Thioalkalivibrio, Thiobaca, Thiobacillus, Thiobacter, Thiobacterium, Thiocapsa, Thioclava, Thiococcus, Thiocystis, Thiodictyon, Thioflavicoccus, Thiohalocapsa, Thiolamprovum, Thiomargarita, Thiomicrospira, Thiomonas, Thiopedia, Thioploca, Thioreductor, Thiorhodococcus, Thiorhodospira, Thiorhodovibrio, Thiosphaera, Thiospira, Thiospirillum, Thiothrix, Thiovirga, Thiovulum, Tindallia, Tissierella, Tistrella, Tolumonas, Toxothrix, Trabulsiella, Treponema, Trichlorobacter, Trichococcus, Tropheryma, Truepera, Tsukamurella, Turicella, Turicibacter, Turneriella, Ulvibacter, Ureaplasma, Ureibacillus, Uruburuella, Vagococcus, Vampirovibrio, Varibaculum, Variovorax, Veillonella, Verrucomicrobium, Verrucosispora, Vibrio, Victivallis, Virgibacillus, Virgisporangium, Virgosporangium, Vitellibacter, Vitreoscilla, Vogesella, Volcaniella, Volucribacter, Vulcanithermus, Waddlia, Wautersia, Weeksella, Weissella, Wigglesworthia, Williamsia, Winogradskyella, Wolbachia, Wolinella, Woodsholea, Xanthobacter, Xanthomonas, Xenophilus, Xenorhabdus, Xylanibacterium, Xylanimicrobium, Xylanimonas, Xylella, Xylophilus, Yania, Yersinia, Yokenella, Zavarzinia, Zimmermannella, Zobellia, Zoogloea, Zooshikella, Zymobacter, Zymomonas,* and *Zymophilus.*

An exemplary *Escherichia coli* strain provided herein includes Nissle 1917 strain.

Exemplary *Bacteroides* species include strains of *Bacteroides ovatus, Bacteroides thetaiotaomicron, Bacteroides fragilis, Bacteroides vulgatus,* or *Bacteroides gracilis.* Exemplary *Eubacterium* species include strains of *Eubacterium limosum, Eubacterium aerofaciens* (aka *Collinsella aerofaciens*), *Eubacterium rectale* or *Eubacterium cylindroids.* Exemplary *Streptococcus* species include strains of *Streptococcus mitis, Streptococcus gordonii, Streptococcus oralis, Streptococcus salivarius, Streptococcus sanguis* or *Streptococcus mutans.* Exemplary of *Actinomyces* species include strains of *Actinomyces naeslundii, Actinomyces viscosus* or *Actinomyces odontolyticus.* Exemplary *Veillonella* species include strains of *Veillonella parvula, Veillonella dispar* or *Veillonella atypical.* Exemplary of *Nesseria* species include strains of *Nesseria cinerea, Nesseria mucosa, Nesseria elongate, Nesseriaflava, Nesseria subflava, Nesseria flavescens, Nesseria sicca, Nesseria lactamica, Nesseria polysacchareae* or *Nesseria kochii.* Exemplary of *Prevotella* species include strains of *Prevotella denticola, Prevotella dentalis, Prevotella buccalis,* or *Prevotella loeschii.* Exemplary of *Campylobacter* species include strains of *Campylobacter concisus, Campylobacter curvus* or *Campylobacter showae.* Exemplary of *Fusobacterium* species include strains of *Fusobacterium nucleatum* or *Fusobacterium periodonticum.* Exemplary of *Eikenella* species include strains of *Eikenella corrodens.* Exemplary of *Porphyromonas* species include strains of *Porphyromonas gingivalis.* Exemplary of *Propionibacteria* species include strains of *Propionibacteria acnes, Propionibacteria freudenreichii.*

In some embodiments, the bacteria provided herein can be extracellular bacteria. A variety of extracellular bacteria are known in the art and include *Vibrio* species, *Lactobacillus* species, *Streptococcus* species, and a variety of *Escherichia* species. Exemplary bacteria include *Vibrio cholerae, Streptococcus pyogenes,* and a variety of *Escherichia coli* strains.

In other embodiments, the bacteria provided herein can be intracellular bacteria. A variety of facultative intracellular bacteria are known in the art and include *Listeria* species, *Salmonella* species, *Shigella* species, *Rickettsiae* species, *Chlamydia* species, *Coxiella* species, *Mycobacterium* species, *Mycoplasma* species, *Yersinia pestis, Neisseria* species, *Bordetella* species, *Legionella* species, *Brucella* species and enteroinvasive *Escherichia coli* strains. Exemplary intracellular bacteria include, but are not limited to, *Listeria monocytogenes, Salmonella typhimurium, Shigella flexneri, Rickettsia conorii, Rickettsia prowazekii, Clostridium piliform, Chlamydia trachomatis, Chlamydia muridaru, Coxiella burnetii, Mycobacterium leprae, Mycoplasma penetrans, Yersinia pestis, Neisseria gonorrhoeae, Bordetella pertussis, Legionella pneumophila, Brucella melitensis,* and *Escherichia coli* O157.

Additional bacteria include plant bacteria such as *Clavibacter michiganensis* subsp. *michiganensis, Agrobacterium* tumefaciens, Erwinia herbicola, Azorhizobium caulinodans, Xanthomonas campestris pv. vesicatoria, and Xanthomonas campestris pv. campestris.

Also provided herein are modifications of bacteria to enhance one or more characteristics relative to the wild-type bacteria. Such characteristics can include, but are not limited to, attenuated pathogenicity, reduced toxicity, preferential accumulation in tumor, increased ability to activate an immune response against tumor cells, increased immunogenicity, increased or decreased replication competence, and the ability to express exogenous proteins, and combinations thereof. In other embodiments, the bacteria can be modified to express one or more detectable genes, including genes that can be used for imaging. In some embodiments, the modified bacteria have an ability to activate an immune response against tumor cells without aggressively killing the tumor cells. In other embodiments, the bacteria can be modified to express one or more genes for harvesting the gene products and/or for harvesting antibodies against the gene products. The tumor-colonizing capability of a variety of bacteria can be directly measured by injecting bacteria into appropriate tumor-bearing animal models and the tumors assessed for colonization. Additionally, specificity of the bacteria to localize to the tumors compared to non-tumorous tissues can be measured.

a. Aerobic Bacteria

Previous studies have postulated that anaerobic bacteria are preferred for administration to tumors (Lemmon et al., Gene Therapy 4: 791-796 (1997)). Previous studies have shown that aerobic bacteria can survive and grow in tumors (See co-pending U.S. application Ser. Nos. 11/238,025, 10/872,156 and 10/866,606). Accordingly, a bacteria used in the methods provided herein can include a bacteria that can survive and grow in an oxygenated environment. In some embodiments, the bacteria must be in an oxygenated environment in order to survive and grow. In other embodiments, the bacteria prefer an oxygenated environment to grow but can survive and grow in an oxygen-free environment, facultative anaerobic.

A variety of aerobic bacteria, some of which are facultative anaerobes, are known in the art and include, but are not limited to Vibrio species, Streptococcus species, Listeria species, Salmonella species, Lactobacillus species, Bacillus species, Pseudomonas species, and Escherichia species. Exemplary bacteria include, but are not limited to Vibrio cholerae, V. cholerae strain CVD-HgR, Streptococcus pyogenes, Streptococcus mitis, Streptococcus gordonii, Streptococcus oralis, Streptococcus salivarius, Streptococcus sanguis Streptococcus mutans, Escherichia coli, Listeria monocytogenes, Salmonella typhimurium, Lactobacillus gasseri, Lactobacillus reuteri, Lactobacillus ruminis, and Lactobacillus salivarius, Bacillus subtilis, Shigella flexneri, Pseudomoas fluorescens, Pseudomonas putida, and enterovasive E. coli (EIEC). Exemplary E. coli strains include, for example, E. coli strain DH5α, E. coli Top10, E. coli MACH-1 and E. coli OMNIMAX.

A further example of aerobic bacteria, some of which are facultative anaerobes, provided herein are probiotic bacteria. Exemplary probiotic microorganisms include, but are not limited to, Streptococcus species, including Streptococcus thermolphilus, Bacillus species, including Bacillus cereus, Bacillus licheniformis, Bacillus pumilus, Bacillus clausii, Bacillus coagulans, Bacillus polyfermenticus, Brevibacillus species, including Brevibacillus brevis laterosporus, Lactococcus species, including Lactococcus lactis, Lactobacillus species, including Lactobacillus acidophilus, Lactobacillus amylovorus, Lactobacillus bifidum, Lactobacillus casei, Lactobacillus crispatus, Lactobacillus fermentum, Lactobacillus gallinarum, Lactobacillus gasseri, Lactobacillus helveticus, Lactobacillus johnsonii, Lactobacillus lactis, Lactobacillus paracasei, Lactobacillus plantarum, Lactobacillus reuteri, Lactobacillus rhamnosus, Lactobacillus salivarius, Escherichia species, including E. coli strain Nissle 1917 ("Nissle;" Schultz et al. J. Microbiol. Methods 61(3): 389-398 (2005)) and other examples, such as Leuconostoc mesenteroides, Enterococcus faecium, Pediococcus acidilactici, and Sporolactobacillus inulinus.

E. coli strain Nissle 1917 lacks defined virulence factors such as alpha-hemolysin and other toxins, mannose-resistant hemagglutinating adhesins, P-fimbrial adhesins, and the semi-rough lipopolysaccharide phenotype (Blum et al. Infection. 23(4):234-236 (1996)). The unique LPS structure furthermore contributes to its decreased immunotoxicity while maintaining serum sensitivity. Serum sensitivity can contribute to selective colonization of Nissle 1917 in immunoprivileged areas such as tumors, since the bacteria would colonize those sites, such as tumors which are sequestered from the immune system. Nissle 1917 possesses enhanced fitness properties in part due to the expression of at least six different iron uptake systems, including siderophores such as aerobactin, salmochelin, enterobactin, and yersiniabactin; chu heme transport locus and a ferric dicitrate transport system. The lack of pathogenicity and probiotic properties have lead to its use for the treatment of gut disorders, such as ulcerative colitis, chronic constipation, Crohn's disease, pouchitis, irritable bowel syndrome, and other forms of colitis and gut perturbations.

b. Anaerobic Bacteria

A bacteria used in the methods provided herein can include a bacteria that does not require oxygen to survive and grow. In some embodiments, the bacteria must be in an oxygen-free environment in order to survive and grow. In other embodiments, the bacteria prefer an oxygen-free environment to grow but can survive and grow in an oxygenated environment, facultative anaerobic.

A variety of anaerobic bacteria are known in the art, including Clostridium species, Bifodobacterium species, and Staphylococcus species. Exemplary anaerobic bacteria include Clostridium histolyticum, Clostridium butyricum, Clostridium novyi, Clostridium sordellii, Clostridium absonum, Clostridium bifermentans, Clostridium difficile, Clostridium histolyticum, Clostridium perfringens, Clostridium beijerinckii, Clostridium sporogenes, Clostridium butyricum, Bifodobacterium adolescentis, Bifidobacterium adolescentis, Bifidobacterium bifidum, Bifidobacterium infantis, Bifidobacterium laterosporus, Bifodobacterium longum, Bifidobacterium animalis, Staphylococcus aureus, Staphylococcus epidermidis, Actinomyces israelii, Eubacterium lentum, Peptostreptococcus anaerobis, Peptococcus prevotti, and Acidaminococcus fermentans.

A further example of anaerobic bacteria provided herein are probiotic bacteria. Exemplary probiotic microorganisms include, but are not limited to Bifodobacterium species, including Bifodobacterium breve, Bifodobacterium lactus, Bifodobacterium longum and Bifidobacterium bifidum, and Clostridium species, including Clostridium butyricum.

A further example of anaerobic bacteria provided herein are other intestinal flora bacteria, including but not limited to, Bacteroides species, including Bacteroides ovatus, Bacteroides thetaiotaomicron, Bacteroides fragilis, Bacteroides vulgatus, or Bacteroides gracilis, Eubacterium species, including Eubacterium limosum, Eubacterium aerofaciens (aka Collinsella aerofaciens), Eubacterium rectale or Eubacterium cylindroids.

A further example of anaerobic bacteria provided herein is magnetic bacteria. Such bacteria allow tumor detection through the accumulation of iron-based contrast agents. Magnetic bacteria can be isolated from fresh and marine sediments. Magnetic bacteria can produce magnetic particles ($Fe_3O_4$; Blakemore, *Annu. Rev. Microbiol.* 36 (1982), 217-238). To do so, the magnetic bacteria have efficient iron uptake systems, which allow them to use both insoluble and soluble forms of iron. *Magnetospirillum* magnetic AMB-1 is an example of such magnetic bacteria that has been isolated and cultured for magnetic particle production (Yang et al., *Enzyme Microb. Technol.* 29: 13-19 (2001)). As provided herein, these magnetic bacteria (naturally occurring or genetically modified, including modification of gene(s) that limit growth conditions, e.g., temperature restriction), when injected intravenously, can selectively accumulate in tumor. Accordingly, these bacteria can be used for accumulating iron-based contrast agents in the tumors, which in turn allows tumor detection by MRI. Similarly, other naturally isolated metal accumulating strains of bacteria can be used for enrichment of bacterial strains, tumor targeting, absorption of metals from contrast agents, tumor imaging, tumor therapy or a combination thereof. Alternatively, metal acquisition systems of metal accumulating strains of bacteria can be transferred to other bacteria.

3. Viruses

Exemplary microorganisms provided herein include viruses. Such viruses typically have one or more of the microorganism characteristics provided herein. For example, viruses provided herein can have attenuated pathogenicity, reduced toxicity, preferential accumulation in immunoprivileged cells and tissues, such as tumor, the ability to activate an immune response against tumor cells, immunogenicity, replication competence, the ability to express exogenous proteins, and combinations thereof. In some embodiments, the viruses have an ability to activate an immune response against tumor cells without aggressively killing the tumor cells. In other embodiments, the viruses can be modified to express one or more detectable genes, including genes that can be used for imaging. In other embodiments, the viruses can be modified to express one or more genes for harvesting the gene products and/or for harvesting antibodies against the gene products.

The viruses provided herein can be cytoplasmic viruses, such as poxviruses, or can be nuclear viruses such as adenoviruses. The viruses provided herein can have as part of their life cycle lysis of the host cell's plasma membrane. Alternatively, the viruses provided herein can have as part of their life cycle exit of the host cell by non-lytic pathways such as budding or exocytosis. In one embodiment, the viruses cause lysis or apoptosis of the virus-infected tumor cells. Alternatively, the viruses provided herein can cause a host organism to develop an immune response to virus-infected tumor cells as a result of lysis or apoptosis induced as part of the viral life cycle. The viruses provided herein also can be genetically engineered to cause a host organism to develop an immune response to virus-infected tumor cells, regardless of whether or not lysis or apoptosis is induced as part of the viral life cycle. In some embodiments, the viruses provided herein can cause the host organism to mount an immune response against tumor cells without lysing or causing cell death of the tumor cells.

One skilled in the art can select from any of a variety of viruses, according to a variety of factors, including, but not limited to, the intended use of the virus (e.g., exogenous protein production, antibody production or tumor therapy), the host organism, and the type of tumor.

a. Cytoplasmic Viruses

The viruses provided herein can be cytoplasmic viruses, where the life cycle of the virus does not require entry of viral nucleic acid molecules in to the nucleus of the host cell. A variety of cytoplasmic viruses are known, including, but not limited to, pox viruses, African swine flu family viruses, and various RNA viruses such as picorna viruses, calici viruses, toga viruses, corona viruses and rhabdo viruses. In some embodiments, viral nucleic acid molecules do not enter the host cell nucleus throughout the viral life cycle. In other embodiments, the viral life cycle can be performed without use of host cell nuclear proteins. In other embodiments, the virulence or pathogenicity of the virus can be modulated by modulating the activity of one or more viral proteins involved in viral replication.

i. Poxviruses

In one embodiment, the virus provided herein is selected from the pox virus family. Pox viruses include Chordopoxyirinae such as orthopoxvirus, parapoxvirus, avipoxvirus, capripoxvirus, leporipoxvirus, suipoxvirus, molluscipoxvirus and yatapoxvirus, as well as Entomopoxyirinae such as entomopoxvirus A, entomopoxvirus B, and entomopoxvirus A. Chordopoxyirinae are vertebrate poxviruses and have similar antigenicities, morphologies and host ranges; thus, any of a variety of such poxviruses can be used herein. One skilled in the art can select a particular genera or individual chordopoxyirinae according to the known properties of the genera or individual virus, and according to the selected characteristics of the virus (e.g., pathogenicity, ability to elicit and immune response, preferential tumor localization), the intended use of the virus, the tumor type and the host organism. Exemplary chordopoxyirinae genera are orthopoxvirus and avipoxvirus.

Avipoxviruses are known to infect a variety of different birds and have been administered to humans. Exemplary avipoxviruses include canarypox, fowlpox, juncopox, mynahpox, pigeonpox, psittacinepox, quailpox, peacockpox, penguinpox, sparrowpox, starlingpox, and turkeypox viruses.

Orthopoxviruses are known to infect a variety of different mammals including rodents, domesticated animals, primates and humans. Several orthopoxviruses have a broad host range, while others have narrower host range. Exemplary orthopoxviruses include buffalopox, camelpox, cowpox, ectromelia, monkeypox, raccoon pox, skunk pox, tatera pox, uasin gishu, vaccinia, variola and volepox viruses. In some embodiments, the orthopoxvirus selected can be an orthopoxvirus known to infect humans, such as cowpox, monkeypox, or vaccinia virus. Optionally, the orthopoxvirus known to infect humans can be selected from the group of orthopoxviruses with a broad host range, such as cowpox, monkeypox, or vaccinia virus.

(a) Vaccinia Virus

One exemplary orthopoxvirus is vaccinia virus. A variety of vaccinia virus strains are available, including Western Reserve (WR), Copenhagen, Tashkent, Tian Tan, Lister, Wyeth, IHD-J, and IHD-W, Brighton, Ankara, MVA, Dairen I, L-IPV, LC16M8, LC16MO, LIVP, WR 65-16, Connaught, New York City Board of Health. Exemplary vaccinia viruses are Lister or LIVP vaccinia viruses. Any known vaccinia virus, or modifications thereof that correspond to those provided herein or known to those of skill in the art to reduce toxicity of a vaccinia virus. Generally, however, the mutation will be a multiple mutant and the virus will be further selected to reduce toxicity.

The linear dsDNA viral genome of vaccinia virus is approximately 200 kb in size, encoding a total of approximately 200 potential genes. Viral gene expression can be divided into three stages. In the early stage, gene expression is mainly for viral replication, and for defense against the host's immune system. In the intermediate stage, genes not available for expression in the early stage can be expressed, including late stage transactivators. In the late stage, active transcription is mainly for viral structural components for building mature viruses.

Vaccinia virus possesses a variety of features for use in cancer gene therapy and vaccination. It has a broad host and cell type range. Vaccinia is a cytoplasmic virus, thus, it does not insert its genome into the host genome during its life cycle. Unlike many other viruses that require the host's transcription machinery, vaccinia virus can support its own gene expression in the host cell cytoplasm using enzymes encoded in the viral genome. The vaccinia virus genome has a large carrying capacity for foreign genes, where up to 25 kb of exogenous DNA fragments (approximately 12% of the vaccinia genome size) can be inserted. The genomes of several of the vaccinia strains have been completely sequenced, and many essential and nonessential genes identified. Due to high sequence homology among different strains, genomic information from one vaccinia strain can be used for designing and generating modified viruses in other strains. Finally, the techniques for production of modified vaccinia strains by genetic engineering are well established (Moss, *Curr. Opin. Genet. Dev.* 3: 86-90 (1993); Broder and Earl, *Mol. Biotechnol.* 13: 223-245 (1999); Timiryasova et al., *Biotechniques* 31: 534-540 (2001)).

Historically, vaccinia virus was used to immunize against smallpox infection. More recently, modified vaccinia viruses are being developed as vaccines to combat a variety of diseases. Attenuated vaccinia virus can trigger a cell-mediated immune response. Strategies such as prime/boost vaccination, vaccination with non-replicating vaccinia virus or a combination of these strategies, have shown promising results for the development of safe and effective vaccination protocols. Mutant vaccinia viruses from previous studies exhibit a variety of shortcomings, including a lack of efficient delivery of the viral vehicle to the desired tissue only (e.g., specific accumulation in a tumors), a lack of safety because of possible serious complications (e.g., in young children, eczema vaccinatum and encephalitis, and in adults disseminated or progressive vaccinia can result if the individual is severely immunodeficient).

(b) Modified Vaccinia Viruses

Provided herein are vaccinia viruses with insertions, mutations or deletions, as described more generally elsewhere herein. The vaccinia viruses are modified or selected to have low toxicity and to accumulate in the target tissue. Exemplary of such viruses are those from the LIVP strain.

Exemplary insertions, mutations or deletions are those that result in an attenuated vaccinia virus relative to the wild type strain. For example, vaccinia virus insertions, mutations or deletions can decrease pathogenicity of the vaccinia virus, for example, by reducing the toxicity, reducing the infectivity, reducing the ability to replicate, or reducing the number of non-tumor organs or tissues to which the vaccinia virus can accumulate. Other exemplary insertions, mutations or deletions include, but are not limited to, those that increase or decrease antigenicity of the microorganism, those that permit detection or imaging, those that increase toxicity of the microorganism (optionally, controlled by an inducible promoter). For example, modifications can be made in genes that are involved in nucleotide metabolism, host interactions and virus formation. Any of a variety of insertions, mutations or deletions of the vaccinia virus known in the art can be used herein, including, but not limited to, insertions, mutations or deletions of: the thymidine kinase (TK) gene, the hemagglutinin (HA) gene, the VGF gene (as taught in U.S. Pat. Pub. No. 20030031681); a hemorrhagic region or an A type inclusion body region (as taught in U.S. Pat. No. 6,596,279); Hind III F, F13L, or Hind III M (as taught in U.S. Pat. No. 6,548,068); A33R, A34R, A36R or B5R genes (see, e.g., Katz et al., *J. Virology* 77: 12266-12275 (2003)); SalF7L (see, e.g., Moore et al., *EMBO J.* 11: 1973-1980 (1992)); N1L (see, e.g., Kotwal et al., *Virology* 171: 579-587 (1989)); M1 lambda (see, e.g., Child et al., *Virology.* 174: 625-629 (1990)); HR, HindIII-MK, HindIII-MKF, HindIII-CNM, RR, or BamF (see, e.g., Lee et al., *J. Virol.* 66: 2617-2630 (1992)); C21L (see, e.g., Isaacs et al., *Proc Natl Acad Sci U.S.A.* 89: 628-632 (1992)); or F14.5L (also known as F3 locus see e.g., U.S. Pat. Pub. No. 2005-0031643-A1, SEQ ID NOS: 44 (nucleotide) and 45 (amino acid translation)).

The viruses provided herein also can contain two or more insertions, mutations or deletions. Thus, included are vaccinia viruses containing two or more insertions, mutations or deletions of the loci provided herein or other loci known in the art.

(c) The Lister Strain

In another embodiment, the viruses and methods provided herein can be based on modifications to the Lister strain of vaccinia virus. Lister (also referred to as Elstree) vaccinia virus is available from any of a variety of sources. For example, the Elstree vaccinia virus is available at the ATCC under Accession Number VR-1549. The Lister vaccinia strain has high transduction efficiency in tumor cells with high levels of gene expression. The LIVP strain has a reduced pathogenicity while maintaining a high transduction efficiency. For example, as provided herein, F3-interrupted modified LIVP vaccinia virus can selectively replicate in tumor cells in vivo.

In one embodiment, the Lister strain can be an attenuated Lister strain, such as the LIVP (Lister virus from the Institute of Viral Preparations, Moscow, Russia) strain, which was produced by further attenuation of the Lister strain. The LIVP strain was used for vaccination throughout the world, particularly in India and Russia, and is widely available and the sequence of nucleotides encoding the LIVP strain is set forth in SEQ ID NO: 47.

ii. Other Cytoplasmic Viruses

Also provided herein are cytoplasmic viruses that are not poxviruses. Cytoplasmic viruses can replicate without introducing viral nucleic acid molecules into the nucleus of the host cell. A variety of such cytoplasmic viruses are known in the art, and include African swine flu family viruses and various RNA viruses such as arenaviruses, picornaviruses, caliciviruses, togaviruses, coronaviruses, paramyxoviruses, flaviviruses, reoviruses, and rhaboviruses. Exemplary togaviruses include Sindbis viruses. Exemplary arenaviruses include lymphocytic choriomeningitis virus. Exemplary rhaboviruses include vesicular stomatitis viruses. Exemplary paramyxo viruses include Newcastle Disease viruses and measles viruses. Exemplary picornaviruses include polio viruses, bovine enteroviruses and rhinoviruses. Exemplary flaviviruses include Yellow fever virus; attenuated Yellow fever viruses are known in the art, as exemplified in Barrett et al., *Biologicals* 25:17-25 (1997), and McAllister et al., *J. Virol.* 74: 9197-9205 (2000).

Also provided herein are modifications of the viruses provided above to enhance one or more characteristics relative to the wild type virus. Such characteristics can include, but are not limited to, attenuated pathogenicity, reduced toxicity, preferential accumulation in tumor, increased ability to activate an immune response against tumor cells, increased or decreased immunogenicity, increased or decreased replication competence, and the ability to express exogenous proteins, and combinations thereof. In some embodiments, the modified viruses have an ability to activate an immune response against tumor cells without aggressively killing the tumor cells. In other embodiments, the viruses can be modified to express one or more detectable genes, including genes that can be used for imaging. In other embodiments, the viruses can be modified to express one or more genes for harvesting the gene products and/or for harvesting antibodies against the gene products.

b. Adenovirus, Herpes, Retroviruses

Further provided herein are viruses that include in their life cycle entry of a nucleic acid molecule into the nucleus of the host cell. A variety of such viruses are known in the art, and include herpesviruses, papovaviruses, retroviruses, adenoviruses, parvoviruses and orthomyxoviruses. Exemplary herpesviruses include herpes simplex type 1 viruses, cytomegaloviruses, and Epstein-Barr viruses. Exemplary papovaviruses include human papillomavirus and SV40 viruses. Exemplary retroviruses include lentiviruses. Exemplary orthomyxoviruses include influenza viruses. Exemplary parvoviruses include adeno associated viruses.

Also provided herein are modifications of the viruses provided above to enhance one or more characteristics relative to the wild type virus. Such characteristics can include, but are not limited to, attenuated pathogenicity, reduced toxicity, preferential accumulation in tumor, increased ability to activate an immune response against tumor cells, increased or decreased immunogenicity, increased or decreased replication competence, and the ability to express exogenous proteins, and combinations thereof. In some embodiments, the modified viruses have an ability to activate an immune response against tumor cells without aggressively killing the tumor cells. In other embodiments, the viruses can be modified to express one or more detectable genes, including genes that can be used for imaging. In other embodiments, the viruses can be modified to express one or more genes for harvesting the gene products and/or for harvesting antibodies against the gene products.

4. Eukaryotic Cells

Also encompassed within the cells provided herein and the methods of making and using such cells are eukaryotic cells, including cells from multi-cellular eukaryotes, including mammals such as primates, where exemplary cells are human cells. Typically the cells are isolated cells. For example, eukaryotic cells can be tumor cells, including mammalian tumor cells such as primate tumor cells, where exemplary primate tumor cells are human tumor cells such as human breast cancer cells. In another example, eukaryotic cells can include fibrosarcoma cells such as human fibrosarcoma cells. Exemplary human fibrosarcoma cells include HT1080 (ATCC Accession Nos. CCL-121, CRL-12011 or CRL-12012). In another example, eukaryotic cells can include stem cells, including mammalian stem cells such as primate stem cells, where exemplary primate stem cells are human stem cells.

Also provided herein are modifications of eukaryotic cells to enhance one or more characteristics relative to the wild type cells. Such characteristics can include, but are not limited to, attenuated pathogenicity, reduced toxicity, preferential accumulation in tumor, increased ability to activate an immune response against tumor cells, increased or decreased immunogenicity, increased or decreased replication competence, and are able to express exogenous proteins, and combinations thereof. In some embodiments, the modified eukaryotic cells have an ability to activate an immune response against tumor cells without aggressively killing the tumor cells. In other embodiments, the modified eukaryotic cells have an ability to kill tumor cells or activate an immune response against tumor cells that kills the tumor cells. In other embodiments, the eukaryotic cells can be modified to express one or more detectable genes,

F. IMAGING

Tumor and or metastasis size can be imaged and/or monitored by any of a variety of methods known in the art, including external assessment methods or other imaging methods such as, for example, tomographic or magnetic imaging.

Microorganisms and cells can be imaged and/or monitored by any of a variety of methods known in the art. Exemplary imaging/monitoring methods include any of a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), gamma rays (after annihilation of a positron and an electron in PET scanning), single-photon emission computed tomography (SPECT), spiral computed tomography and ultrasonic tomography. Other exemplary imaging methods include low-light imaging, X-rays, ultrasound signal, fluorescence, absorption.

In a particular embodiment, the diagnostic or pharmaceutical composition of the provided herein contains a microorganism or cell containing a DNA sequence encoding a protein capable of inducing a signal detectable by magnetic resonance imaging (MRI), e.g. metal-binding proteins. Furthermore, the protein can bind contrast agents, chromophores, ligands or compounds required for visualization of tissues.

For generating the DNA sequences and for constructing expression vectors, bacteria, eukaryotic cells or viruses which contain the DNA sequences, it is possible to use general methods known in the art. These methods include e.g. in vitro recombination techniques, synthetic methods and in vivo recombination methods as described in Sambrook et al., *Molecular Cloning, A Laboratory Manual*, $2^{nd}$ edition (1989) Cold Spring Harbor Laboratory Press, Cold Spring Harbor, N.Y., for example. Methods of transfecting cells, of phenotypically selecting transfectants and of expressing the DNA sequences by using vectors are known in the art. Methods of transforming cells, of phenotypically selecting transformants and of expressing the DNA sequences by using vectors are known in the art.

Contrast agents are used for magnetic resonance imaging. Exemplary contrast agents are iron, gold, gadolinium and gallium. Gallium imaging is a nuclear medicine method for the detection of infections and cancers. Gallium-67 ($^{67}Ga$) binds to transferrin, lactoferrin and bacterial siderophores. Iron imaging also provides for a nuclear medicine method for the detection of infections and cancer. Iron binds to extracellular proteins such as transferrin, lactoferrin and bacterial siderophores. Microorganisms and cells provided herein can be modified to express, for example, recombinant transferrin receptors, lactoferrin receptors and outer membrane proteins. It is also taken up by cancer cells in an increased amount. An increased uptake and, thus, increased radiation levels, indicates an infection of cancer.

Labels appropriate for magnetic resonance imaging are known in the art, and include, for example, fluorine, gadolinium chelates, metals and metal oxides, such as for example, iron, gallium, gold, gadolinium, magnesium, $^1$H, $^{19}$F, $^{13}$C, and $^{15}$N labeled compounds, etc. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as $^{123}$I. Other exemplary radionuclides that can, be used, for example, as tracers for PET include $^{55}$Co, $^{67}$Ga, $^{68}$Ga, $^{60}$Cu(II), $^{67}$Cu(II), $^{99}$Tc, $^{57}$Ni, $^{52}$Fe and $^{18}$F. Examples of useful radionuclide-labeled agents are, for example, proteins, peptides, antibodies, $^{18}$FDG, $^{99}$Tc, $^{64}$Cu-labeled engineered antibody fragment, $^{64}$Cu-labeled somatostatin, $^{64}$Cu-pyruvaldehyde-bis(N4-methylthiosemicarbazone)($^{64}$Cu-PTSM), $^{52}$Fe-citrate, $^{52}$Fe/$^{52m}$Mn-citrate and $^{52}$Fe-labeled iron (III) hydroxide-sucrose complex (Wu et al., *PNAS USA* 97: 8495-8500 (2002); Lewis et al., *J. Med. Chem.* 42: 1341-1347 (1999); Adonai et al., *PNAS USA* 99: 3030-3035 (2002); Leenders et al., *J. Neural. Transm. Suppl.* 43: 123-132 (1994); Calonder et al., *J. Neurochem.* 73: 2047-2055 (1999); Beshara et al., *Br. J. Haematol.* 104: 288-295, 296-302 (1999)). Metabolic compounds that are only taken up by bacteria could be labeled with $^{13}$C and injected into the animal. Likewise, $^{18}$F compounds can be injected that are either metabolized or used in prodrug formulations (like 5-FC) with the microorganisms and cells expressing a prodrug converting enzyme (like cytosine deaminase) can be used in the imaging methods provided herein.

In any of the imaging methods provided herein, the microorganisms and cells can express a gene that can bind a detectable compound or that can form a product that can bind a detectable compound. A variety of gene products, such as proteins, that can specifically bind a detectable compound are known in the art including, but not limited to, receptors, metal binding proteins (e.g., siderophores and ferritins), ligand binding proteins, and antibodies. In one embodiment, the diagnostic composition is a microorganism or cell containing a DNA sequence encoding a protein capable of inducing a signal detectable by magnetic resonance imaging (MRI). Furthermore, the protein can bind contrast agents, chromophores, ligands or compounds required for visualization of tissues.

In any of the imaging methods provided herein, the microorganisms and cells that express a gene that can bind a detectable compound or that can form a product that can bind a detectable compound can be regulated by an inducible promoter. Exemplary inducible promoters are described elsewhere herein and include, for example, an arabinose inducible system (e.g., $P_{BAD}$). Methods of imaging microorganisms and cells that express a detectable gene product gene regulated by inducible promoter can include imaging prior to and following administration of an agent for induction of gene expression. Such agents include inducer molecules, such as a sugar (e.g., arabinose) for the induction of gene expression. In a non-limiting example, bacteria that express an iron binding protein, such as a ferritin, can be imaged following administration of the bacteria to a subject but prior to administration of the inducing agent, and then imaged after administration of the inducing agent. Comparison of imaging before and after the administration of the inducing agent can the be used to determine the location of the bacteria.

An exemplary list of radionuclides useful for the imaging methods provided herein includes, for example, $^{11}$Carbon, $^{11}$Fluorine $^{13}$Carbon, $^{13}$Nitrogen, $^{15}$Nitrogen, $^{15}$Oxygen, $^{18}$Fluorine, $^{19}$Fluorine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttrium, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium $^{186}$Rhenium, $^{188}$Rhenium, $^{192}$Iridium, $^{198}$Gold, $^{201}$Thallium, $^{211}$Astatine, $^{212}$Bismuth and $^{213}$Bismuth. One of skill in the art can alter the parameters used in different imaging methods (MRI, for example) in order to visualize different radionuclides/metals. For example, T2 weighted imaging MRI is used to visualize iron, while T1 weighted imaging can be used to visualize gadolinium.

In general, for practice of the methods herein and when using the microorganisms provided herein for detection of a tumor, the tumor is not excised, and can be imaged externally to the subject. Methods of excising tumor tissue for analysis, including assessment of accumulation of the microorganism and/or gene expression, however, are not excluded and can be used alone or in combination with the methods of detection provided herein.

1. Ferritins

Most reporter genes developed for MRI rely on exogenous administration of contrast material. Because of the crystalline ferrihydrite core, ferritins have an anomalously high superparamagnetism and a marked effect on solvent NMR relaxation rates, making ferritins ideal molecules to express for in vivo MRI studies (Genove et al. *Nature Medicine* 11(4): 450-454 (2005); Cohen et al. *Neoplasia* 7(2): 109-117 (2005)).

Recombinant gene technology can be used to over-express ferritin, which accumulates iron, and thereby, generates its own contrast agent. Microorganisms and cells can be used to specifically target and replicate in tumors. Using such microorganisms and cells engineered to over-express ferritins to target tumors, increased iron accumulation can increase tumor detection by MRI. Alternatively metals such as $^{67}$Ga which are compatible with SPECT or other imaging modalities can be chelated in vivo in ferritins or similar molecules.

Bacteria can be used to increase iron accumulation for visualization. For example, tumor tissues can be specifically infected by intravenously injected bacteria (e.g., *E. coli* Nissle 1917) carrying genes encoding, for example, expressing or over-expressing endogenous or exogenous ferritin-like molecules. Expression of the ferritin-like molecules in the bacteria cells will mark these cells for increased iron storage. Internalization iron storage causes increased contrast agent for in vivo imaging. In addition, internalization of iron by the bacteria can deplete iron from the tumor environment, thereby causing tumor cell lysis. Bacteria can be further recombinantly engineered to over-express siderophores and siderophore receptors, thereby increasing the contrast agent in vivo.

Viruses (such as Vaccinia virus) also can be used to increase iron accumulation by tumor cells for visualization. For example, the tumor tissues can be specifically infected by intravenously injected engineered Vaccinia virus carrying genes encoding ferritin-like molecules. Expression of the ferritin-like molecules in the tumor cells will mark these cells for increased iron storage. Internalization iron storage in the tumor cells causes increased contrast agent for in vivo imaging. Following imaging of the tumor, iron conjugated to an anti-cancer agent can be intravenously administered, thereby causing tumor cell lysis. In addition, viruses can be further recombinantly engineered to carry genes encoding iron-uptake receptors, such as the transferrin receptor or the lactoferrin receptor (along with a signal sequence for cell surface expression) for increased iron capture.

Eukaryotic cells can be used to increase iron accumulation for visualization. For example, tumor tissues can be specifically infected by intravenously injected eukaryotic cells carrying genes encoding, for example, expressing or over-expressing endogenous or exogenous ferritin-like molecules. For example, eukaryotic cells can be engineered to over-express H chains, L chains, or a combination of both. In another example, eukaryotic cells can be engineered to express or over-express a bacterial ferritin-like molecule. Expression of the ferritin-like molecules in the eukaryotic cells will mark these cells for increased iron storage. Internalization iron storage accumulation causes increased contrast agent for in vivo imaging. In addition, internalization of iron by the eukaryotic cells can deplete iron from the tumor environment, thereby causing tumor cell lysis. Eukaryotic cells can be further recombinantly engineered to express or over-express such as the transferrin receptor or the lactoferrin receptor (along with a signal sequence for cell surface expression) thereby increasing iron accumulation for in vivo imaging.

Thus, microorganisms, e.g. bacteria, viruses and eukaryotic cells can be recombinantly engineered to express ferritin-like molecules that can be used to detect primary and metastatic tumors.

These systems are advantageous because they target the tumor specifically without affecting normal tissue and the location of the delivery system inside the tumor cells (i.e., viruses and intracellular bacteria) or in the tumor environment (i.e., bacteria and eukaryotic cells) can be verified by direct visualization before delivering a therapeutic agent conjugated to the ligand.

Accordingly, one embodiment relates to a diagnostic composition containing a microorganism or cell containing a DNA sequence encoding one or more ferritin-like molecules. Any microorganism or cell is useful for the diagnostic methods provided herein, provided that they replicate in the tumor cell (i.e., virus) or in the tumor environment (i.e., bacteria and eukaryotic cells), are not pathogenic for the organism e.g. attenuated, and are recognized by the immune system of the organism, etc.

2. Siderophores

Bacteria can bind and take up siderophores complexed to iron. The siderophores can then be recycled or metabolized and the bacteria can used the free iron for their metabolism or store it in molecules, such as ferritin. Loaded (radio-) labeled siderophores can be systemically injected into tumor-bearing patients having bacteria-colonized tumors. The intra-tumoral bacteria specifically bind and take up the complexed siderophores, thereby taking up the radiolabel which, in turn, can be visualized using PET, SPECT or autoradiography. Either complexed iron or the siderophore itself will be radiolabeled. (Buss et al., *Curr Top Med Chem.* 4(15):1623-35 (2004)). Bacteria can be recombinantly engineered as described elsewhere herein to over-express endogenous or exogenous siderophores. The bacteria can also be recombinantly engineered to express heterologous siderophore receptors or over-express their own siderophore receptors. Alternatively, or in addition, bacteria can be recombinantly engineered as described elsewhere herein such that genes involved in siderophore biosynthesis are inactivated/deleted.

Inactivation of bacterial metal-regulatory systems (e.g., Fur) in combination with or without over-expression of siderophores will up-regulate metal-scavenging pathways, e.g. siderophore receptors, which will bind host metal chelates or delivered compounds and render the bacteria more visible to imaging modalities. Such bacteria can be used in magnetic resonance imaging methods provided herein to increase accumulation of an endogenous contrast agent (i.e., iron) and, optionally, an exogenously administered contrast agent (e.g., $^{67}$Ga).

Bacteria can be used to increase iron accumulation for visualization. For example, tumor tissues can be specifically infected by intravenously injected bacteria (e.g., *E. coli* Nissle 1917) carrying genes encoding, for example, expressing or over-expressing endogenous or exogenous siderophores and expressing or over-expressing endogenous or exogenous siderophore receptors. Expression of the siderophore receptor on the bacteria cell surface will mark these cells for increased targeting by siderophore-metal pairs. Internalization of the siderophore-metal (e.g., iron, gadolinium, or gallium) pair allows the internalization of the contrast agent. In addition, internalization of iron by the bacteria can deplete iron from the tumor environment, thereby causing tumor cell lysis. Bacteria can be further recombinantly engineered to over-express ferritin-like compounds, thereby increasing the contrast agent in vivo.

Viruses (such as Vaccinia virus) also can be used to increase iron (or another detectable contrast agent) accumulation by tumor cells for visualization. For example, the tumor tissues can be specifically infected by intravenously injected engineered Vaccinia virus carrying, e.g., a siderophore receptor gene and, optionally, a siderophore gene (also encoding signal peptides for cell surface expression and secretion). Expression of the siderophore receptor on the tumor cell surface will mark these cells for targeting by siderophores. Tumor cell internalization of the siderophore-metal (e.g., iron, gadolinium, or gallium) pair allows the internalization of the contrast agent. Alternatively, when a siderophore is itself radiolabeled, tumor cell internalization of the siderophore allows the internalization of the contrast agent. In addition, internalization of the siderophore-metal (e.g., iron, gadolinium, or gallium) pair can result in accumulation of iron to a toxic level, thereby causing tumor cell lysis.

Eukaryotic cells also can be used to increase iron accumulation. Eukaryotic cells also can be used to bind a diagnostic and/or a therapeutic label as described elsewhere herein. For example, the tumor tissues can be specifically infected by intravenously injected engineered eukaryotic cells carrying, e.g., a siderophore receptor gene (also encoding signal peptides for cell surface expression). The eukaryotic cells can also carry a gene encoding an enzyme involved in siderophore biosynthesis (also encoding signal peptides for expression and secretion). Expression of the siderophore receptor on the eukaryotic cell surface will mark these cells for targeting by siderophores. Internalization of the siderophore-metal (e.g., iron, gadolinium, or gallium) pair allows the internalization of the contrast agent. In addition, internalization of the siderophore-metal (e.g., iron, gadolinium, or gallium) pair can result depletion of iron from the tumor environment, thereby killing tumor cells.

Thus, microorganisms, e.g. bacteria, viruses and eukaryotic cells can be recombinantly engineered to secrete siderophores and their cell surface receptors that can be used to detect primary and metastatic tumors. Microorganisms and cells can also be recombinantly engineered to have inactivated/deleted siderophore genes or genes that encode enzymes that process siderophores. Cell surface receptors can bind ex vivo siderophores and, thus, can be used to detect primary and metastatic tumors.

These systems are advantageous because they target the tumor specifically without affecting normal tissue and the location of the delivery system inside the tumor cells (i.e., viruses and intracellular bacteria) or in the tumor environment (i.e., bacteria and eukaryotic cells) can be verified by direct visualization before delivering a therapeutic agent conjugated to the ligand.

Accordingly, one embodiment relates to a diagnostic composition containing a microorganism or cell containing a DNA sequence encoding one or more siderophores and cell-surface receptors. Any microorganism or cell is useful for the diagnostic methods provided herein that they replicate in the tumor cell (i.e., virus) or in the tumor environment (i.e., bacteria and eukaryotic cells), are not pathogenic for the organism e.g. attenuated compared to the wild-type microorganism. Optionally, the microorganism or cell is recognized by the immune system of the subject, etc.

3. Surface Ligands

Tumor targeting/replicating bacteria can be used to display specific peptides on their surface to attract and bind single molecules/fusion products and/or nanoparticles. This binding can lead to enhanced diagnostic signals. For example, bacteria can express peptides on their surface that can be visualized using ligand conjugates. Ligand conjugates can be, for example, enzymes, antibodies, peptides, nanoparticles or fusions or combinations thereof, and can be, optionally, labeled with a diagnostic moiety (e.g., a fluorophore, a luminescent protein, a fluorescent protein, etc.).

Bacteria (such as *E. coli* Nissle 1917) can be used to label the bacteria cell surface with receptor proteins. For example, the tumor tissues can be specifically infected by intravenously injected engineered *E. coli* Nissle 1917 carrying, e.g., a transferrin receptor gene (also encoding a signal peptide for cell surface expression). Expression of the transferrin receptor on the bacteria cell surface will mark these cells for targeting by diagnostic- and/or therapeutic-ligand fusion proteins. In this case, the ligand is the transferrin protein, and the diagnostic moiety protein could be, for example, labeled iron. Bacteria cell internalization of the transferrin/transferrin receptor pair allows the internalization of the labeled iron, which in turn delivers the diagnostic moiety specifically to the tumor cells. Transferrin/transferrin receptor pair is only one of many examples of ligand-receptor pairs that can be used. In addition, mutant ligands and mutant receptors with highly specific affinity toward each other can be used to avoid the binding to endogenous proteins. In one non-limiting example, a cell surface protein carries an exposed surface peptide and an antibody immunoreactive with the peptide conjugated to a diagnostic moiety is administered. In a further embodiment, a subsequent administration of a therapeutic agent using any of the methods described herein can be used to treat a subject that has been diagnosed as having a cancer, tumor or metastasis.

Viruses (such as Vaccinia virus) also can be used to label the tumor cell surface with receptor proteins. For example, the tumor tissues can be specifically infected by intravenously injected engineered Vaccinia virus carrying, e.g., a transferrin receptor gene (also encoding a signal peptide for cell surface expression). Expression of the transferrin receptor on the tumor cell surface will mark these cells for targeting by therapeutic-ligand fusion proteins. In this case, the ligand is the transferrin protein, and the diagnostic moiety protein could be, for example, labeled iron. Tumor cell internalization of the transferrin/transferrin receptor pair allows the internalization of the labeled iron, which in turn delivers the diagnostic moiety specifically to the tumor cells. Transferrin/transferrin receptor pair is only one of many examples of ligand-receptor pairs that can be used. In addition, mutant ligands and mutant receptors with highly specific affinity toward each other can be used to avoid the binding to endogenous proteins. In one non-limiting example, a cell surface protein carries an exposed surface peptide and an antibody immunoreactive with the peptide conjugated to a diagnostic moiety is administered. In a further embodiment, a subsequent administration of a therapeutic agent using any of the methods described herein can be used to treat a subject that has been diagnosed as having a cancer, tumor or metastasis.

Eukaryotic cells can be recombinantly engineered to express any of the ligand pairs described herein for use in imaging of tumors. For example, a eukaryotic cell can be recombinantly engineered to express an outer membrane protein with a streptavidin binding peptide (Omp/SA-B) in one of the outer loops on the cell surface. The Omp/SA-B complex will mark these cells for targeting by diagnostic- and/or therapeutic-ligand fusion proteins. In this case, the ligand is streptavidin, and the by diagnostic- and/or therapeutic-ligand fusion proteins could be any of those provided herein. Internalization of the ligand-receptor pair, or attachment to the cell surface of, the diagnostic moiety or therapeutic agent targets the cells, and therefore the tumors, for imaging and/or therapy. The streptavidin binding peptide-streptavidin pair is only one of many examples of peptide-ligand-pairs that can be used. In addition, mutant ligands and mutant receptors with highly specific affinity toward each other can be used to avoid the binding to endogenous proteins.

Thus, microorganisms, e.g. bacteria, viruses and eukaryotic cells can be recombinantly engineered to express receptors or cell surface ligands that can be used to detect primary and metastatic tumors.

These systems are advantageous because they target the tumor specifically without affecting normal tissue; the expression and secretion of the gene constructs can be under the control of an inducible promoter, enabling secretion to be switched on or off; and the location of the delivery system inside the tumor can be verified by direct visualization before delivering a therapeutic agent conjugated to the ligand.

Accordingly, one embodiment relates to a diagnostic composition containing a microorganism or cell containing a DNA sequence encoding a cell-surface protein. Any microorganism or cell is useful for the diagnostic methods provided herein, provided that they replicate in the tumor cell (i.e., viruses or intracellular bacteria) or in the tumor environment (i.e., extracellular bacteria and eukaryotic cells), are not pathogenic for the organism.

In another embodiment, Gene-Directed Enzyme Prodrug Therapy (GDEPT), for example, can be used in which extracellular bacteria and/or eukaryotic cells are engineered to secrete an enzyme, or to express a cell-surface attached enzyme, that converts a non-toxic prodrug into a cytotoxic drug. Alternatively, or in addition to, viruses can be engineered to promote tumor cell expression of a secreted or cell-surface attached enzyme that converts a non-toxic prodrug into a cytotoxic drug. Following administration of the engineered bacteria, eukaryotic cells, and/or viruses, the microorganisms and cells are allowed to proliferate and produce the prodrug converting enzyme at the site of the tumor. After a period of time the prodrug is delivered intravenously, or by alternative delivery method, and the prodrug is converted to the cytotoxic form at the site of the tumor, causing toxicity in the surrounding tumor cells.

Optionally, the prodrug converting enzymes can be expressed by the microorganism or cell in conjunction with a ligand or receptor. The prodrug converting enzymes can also be expressed as a fusion protein with a ligand or receptor. Prodrugs can be engineered with an attached moiety that promotes localization of the prodrug to the site of the tumor. The moiety can include, but is not limited to an antibody, a ligand, a small molecule, or other detectable molecule that binds to the ligand or receptor expressed by the engineered microorganism.

Exemplary prodrug converting enzymes with their prodrug partners include, but are not limited to, Herpes simplex virus thymidine kinase/gancyclovir, varicella zoster thymidine kinase/gancyclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl)(2-mesuloxyethyl)amino] benzoyl-L-glutamic acid, cytochrome P450/acetominophen, horseradish peroxidase/indole-3-acetic acid, nitroreductase/CB 1954, rabbit carboxylesterase/7-ethyl-10-[4-(1-piperidino)-1-piperidino]carbonyloxycampotothecin, mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin-glucoronide, thymidine phosphorylase/5'-deoxy-5-fluorouridine, deoxycytidine kinase/cytosine arabinoside, beta-lactamase and linamerase/linamarin.

4. Detectable Gene Products

In other embodiments, the microorganism or cell can express a gene that encodes a product that can bind a detectable compound, encodes a product that emits a detectable light or that can form a product that can bind a detectable compound. A variety of gene products, such as proteins, that can specifically bind a detectable compound are known in the art, including receptors, metal binding proteins, ligand binding proteins, and antibodies. A variety of gene products, such as proteins that emit a detectable light, including luciferases and fluorescent proteins can be used. Any of a variety of detectable compounds can be used, and can be imaged by any of a variety of known imaging methods. Exemplary compounds include receptor ligands and antigens for antibodies. The ligand can be labeled according to the imaging method to be used.

The person skilled in the art knows DNA sequences encoding luminescent or fluorescent proteins that can be used in the diagnostic or pharmaceutical methods provided herein. During the past decade, the identification and isolation of structural genes encoding light-emitting proteins from bacterial luciferase from *Vibrio harveyi* and from *Vibrio fischerii*, firefly luciferase, click beetle luciferase, aequorin from *Aequorea Victoria*, *Renilla* luciferase from *Renilla reniformis* and green fluorescent protein (GFP) from *Aequorea Victoria* (Prasher et al., *Gene* 111: 229-233 (1987)) or *Renilla* sea pansy, and other sea anemone and coral species, and variants thereof, including yellow fluorescent protein (YFP), orange fluorescent protein (OFP), cyan fluorescent protein (CFP), and blue fluorescent protein (BFP), red fluorescent protein (RFP) and far-red fluorescent proteins from the corallimorph Discosoma (Matz et al., *Nature Biotechnology* 17: 969-973 (1999)), *Heteractis* reef coral and other sea anemone and coral species, as well as variants thereof including DsRed2 (Clontech, Palo Alto, Calif.), DsRed-T1 (Bevis and Glick, Nat. Biotechnol., 20: 83-87 (2002)), mPlum (Wang et al., PNAS USA. 101(48): 16745-9 (2004)), HcRed1 and t-HcRed (Clontech, Palo Alto, Calif.), and near-infrared fluorescent proteins have been described that allow the tracing of bacteria or viruses based on light emission (Belas et al., *Science* 218: 791-793 (1982); Bevis and Glick, *Nat. Biotechnol.*, 20: 83-87 (2002); Foran and Brown, Nucleic acids Res. 16: 177 (1988); de Wet et al., *Mol. Cell. Biol.* 7: 725-737 (1987); Matz et al., *Nature Biotechnology* 17: 969-973 (1999); Prasher et al., *Biochem.* 26: 1326-1332 (1987); Lorenz et al., *PNAS USA* 88: 4438-4442 (1991); Prasher et al., *Gene* 111: 229-233 (1987)). Transformation and expression of these genes in bacteria allows detection of bacterial colonies with the aid of a low light imaging camera or individual bacteria under a fluorescent microscope (Engebrecht et al., *Science* 227 (1985), 1345-1347; Legocki et al., *PNAS* 83 (1986), 9080-9084; Chalfie et al., *Science* 263 (1994), 802-805).

Luciferase genes have been expressed in a variety of organisms. Promoter activation based on light emission, using luxAB fused to the nitrogenase promoter, was demonstrated in *Rhizobia* residing within the cytoplasm of cells of infected root nodules by low light imaging (Legocki et al., *PNAS* 83 (1986), 9080-9084; O'Kane et al., *J. Plant Mol. Biol.* 10 (1988), 387-399). Fusion of the luxA and luxB genes resulted in a fully functional luciferase protein (Escher et al., *PNAS* 86 (1989), 6528-6532). This fusion gene (Fab2) was introduced into *Bacillus subtilis* and *Bacillus megaterium* under the xylose promoter and then fed into insect larvae and was injected into the hemolymph of worms. Imaging of light emission was conducted using a low light video camera. The movement and localization of pathogenic bacteria in transgenic *Arabidopsis* plants, which carry the pathogen-activated PAL promoter-bacterial luciferase fusion gene construct, was demonstrated by localizing *Pseudomonas* or *Erwinia* spp. infection under the low light imager as well as in tomato plant and stacks of potatoes (Giacomin and Szalay, *Plant Sci.* 116 (1996), 59-72).

All of the luciferases expressed in bacteria require exogenously added substrates such as decanal or coelenterazine for light emission. In contrast, while visualization of GFP fluorescence does not require a substrate, an excitation light source is needed. More recently, the gene cluster encoding the bacterial luciferase and the proteins for providing decanal within the cell, which includes luxCDABE was isolated from *Xenorhabdus luminescens* (Meighen and Szittner, *J. Bacteriol.* 174 (1992), 5371-5381) and *Photobacterium leiognathi* (Lee et al., *Eur. J. Biochem.* 201 (1991), 161-167) and transferred into bacteria resulting in continuous light emission independent of exogenously added substrate (Fernandez-Pinas and Wolk, *Gene* 150 (1994), 169-174). Bacteria containing the complete lux operon sequence, when injected intraperitoneally, intramuscularly, or intravenously, allowed the visualization and localization of bacteria in live mice indicating that the luciferase light emission can penetrate the tissues and can be detected externally (Contag et al., *Mol. Microbiol.* 18 (1995), 593-603).

An exemplary use of the microorganisms and cells described above is the preparation of a diagnostic composition for tumor-imaging. The diagnostic compositions provided herein can be used, for example, during surgery, to identify tumors and metastasis. Furthermore, the diagnostic compositions provided herein are useful for monitoring a therapeutic tumor treatment. Suitable devices for analyzing the localization or distribution of luminescent and/or fluorescent proteins in an organism, organ or tissue are well known to the person skilled in the art and, furthermore described in the literature cited above as well as the Examples, below.

It is the object of the methods provided herein to provide a means for the efficient and reliable diagnosis of tumors.

Light-emitting recombinant bacteria (e.g., *B. subtilis*, *V. cholerae*, *S. flexneri*, *E. coli* DH5α, EIEC 4608-58, and *E. coli* Nissle 1917) which were injected intravenously into mice could be visualized in whole animals under a low light imager as shown in the Examples. Three days post-injection of bacteria, mice were administered an arabinose solution to induce gene expression of the diagnostic moiety. Six-hours post-arabinose injection, increasing light emission originating from the tumor regions was observed, but not non-tumor regions or internal organs. This observation indicates a continuous bacterial replication in the tumor tissue. The extent of light emission is dependent on the bacterial strain used. *E. coli* Nissle 1917 light-emitting bacteria replicated better, and for a longer period of time, in tumors than did other bacteria tested. See Example 5.

As shown in co-pending U.S. application Ser. Nos. 10/872,156 and 11/238,025, when Vaccinia virus (LIVP strain) carrying the light emitting fusion gene construct was injected intravenously into nude mice, the virus particles were found to be cleared from all internal organs within 4 days, as determined by extinction of light emission. In contrast, when Vaccinia virus was injected intravenously into nude mice bearing tumors (e.g., glioma, human prostate tumor cells, human breast tumors, human bladder tumors), virus particles were found to be retained over time in tumor tissues, resulting in lasting light emission. The presence and amplification of the virus-encoded fusion proteins in the same tumor were monitored in live animals by observing GFP fluorescence under a stereomicroscope and by collecting luciferase-catalyzed light emission under a low-light video-imaging camera. Tumor-specific light emission was detected 4 days after viral injection, became more intense after the 4th post-injection day and lasted for 30 to 45 days, indicating continued viral replication. Further, mammalian cells expressing GFP fusion proteins, upon injection into the bloodstream, have been found to home into and propagate in glioma tumors.

Thus, light-emitting cells or microorganisms, e.g. bacteria, viruses and eukaryotic cells can be used to detect primary and metastatic tumors.

These systems are advantageous because they target the tumor specifically without affecting normal tissue; the expression and secretion of the gene constructs can be under the control of an inducible promoter, enabling secretion to be switched on or off; and the location of the delivery system inside the tumor can be verified by direct visualization before activating gene expression and protein delivery.

Accordingly, one embodiment relates to a diagnostic composition containing a microorganism or cell containing a DNA sequence encoding a detectable protein or a protein capable of inducing a detectable signal. Any microorganism or cell is useful for the diagnostic methods provided herein, provided that they replicate in the tumor cell (i.e., viruses and intracellular bacteria) or in the tumor environment (i.e., extracellular bacteria and eukaryotic cells), are not pathogenic for the organism e.g. attenuated and, are recognized by the immune system of the organism, etc. In a particular embodiment, the diagnostic or pharmaceutical composition is a microorganism or cell containing a DNA sequence encoding a luminescent and/or fluorescent protein.

G. THERAPY

Provided herein are therapeutic methods, including methods of treating, delaying progression of immunoprivileged cells or tissue, or preventing immunoprivileged cells or tissue, including cancerous cells, tumors and metastases. The methods provided herein include administering a microorganism or cell to a subject containing one or more tumor(s) and/or metastases. The microorganisms and cells and methods provided herein can be administered to kill tumor cells, decrease the tumor size, or prevent or delay expansion of the tumor.

Tumors that can be treated with the microorganisms or cells provided herein include, but are not limited to, bladder tumors, breast tumors, prostate tumors, glioma tumors, adenocarcinomas, ovarian carcinomas, and pancreatic carcinomas, liver tumors and skin tumors. In one example, the human malignancy treated is a cancer such as, but not limited to, pancreatic cancer, non-small cell lung cancer, multiple myeloma, or leukemia. In addition, other metastatic diseases can be treated by the methods provided herein. Cancers can also be cancer-forming solid tumors, such as lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS.

The administered microorganisms and cells can posses one or more characteristics including attenuated pathogenicity, low toxicity, preferential accumulation in tumors, increased ability to capture, transport and or store iron, immunogenicity, replication competence, an ability to express or over-express exogenous genes, an ability to over-express endogenous genes and an ability to bind ligands.

The microorganisms provided herein can be administered to a subject without causing microorganism-induced disease in the subject. In some embodiments, the microorganisms can accumulate in tumors or metastases. In some embodiments, the microorganisms can elicit an anti-tumor response in the subject, where typically the microorganism-mediated anti-tumor response can develop over several days, such a week or more, 10 days or more, two weeks or more, or a month or more, as a result of little or no microorganism-cause tumor cell death. In some exemplary methods, the microorganisms or cells can be present in the tumor, and can cause an anti-tumor response without the microorganism or cell itself causing enough tumor cell death to prevent tumor growth.

Also provided herein are methods for inhibiting tumor growth in a subject, where the methods include administering to a subject a microorganism or cell that can accumulate in a tumor and/or metastasis, and/or can cause or enhance an anti-tumor response. The anti-tumor response induced as a result of tumor or metastases-accumulated microorganisms or cells can result in inhibition of tumor growth, shrinkage, and/or elimination of the tumor.

Also provided herein are methods for delaying or inhibiting growth or formation of a metastasis in a subject, where the methods include administering to a subject a microorganism or cell that can accumulate in a tumor and/or metastasis, and/or can cause or enhance an anti-tumor response. The anti-tumor response induced as a result of tumor or metastasis-accumulated microorganisms or cells can result in inhibition of metastasis growth or formation.

Also provided herein are methods for decreasing the size of a tumor and/or metastasis in a subject, where the methods include administering to a subject a microorganism or cell that can accumulate in a tumor and/or metastasis, and can cause or enhance an anti-tumor response. The anti-tumor response induced as a result of tumor or metastasis-accumulated microorganisms or cells can result in a decrease in the size of the tumor and/or metastasis. The administered microorganisms can posses one or more characteristics including attenuated pathogenicity, low toxicity, preferential accumulation in tumors, increased ability to capture, transport and or store iron, immunogenicity, replication competence, an ability to express or over-express exogenous genes, an ability to over-express endogenous genes, an inactivation/deletion of an endogenous gene(s) and an ability to bind ligands.

Also provided herein are methods for eliminating a tumor and/or metastasis from a subject, where the methods include administering to a subject microorganisms or cells that can accumulate in a tumor and/or metastasis, and can cause or enhance an anti-tumor response. The anti-tumor response induced as a result of tumor or metastasis-accumulated microorganisms or cells can result in elimination of the tumor and/or metastasis from the subject. The administered microorganisms or cells can posses one or more characteristics including attenuated pathogenicity, low toxicity, preferential accumulation in tumors, increased ability to capture, transport and or store iron, immunogenicity, replication competence, an ability to express or over-express exogenous genes, an ability to over-express endogenous genes, an inactivation/deletion of an endogenous gene(s) and an ability to bind ligands.

Methods of reducing inhibiting tumor growth, inhibiting metastasis growth and/or formation, decreasing the size of a tumor or metastasis, eliminating a tumor or metastasis, or other tumor therapeutic methods provided herein include causing or enhancing an anti-tumor response in the host, depleting a vital nutrient (e.g., iron) from the tumor environment, or delivering a therapeutic agent to the tumor. The response of the host, being anti-tumor in nature, can be mounted against tumors and/or metastases in which microorganisms or cells have accumulated, and can also be mounted against tumors and/or metastases in which microorganisms or cells have not accumulated, including tumors and/or metastases that form after administration of the microorganisms or cells to the subject. Accordingly, a tumor and/or metastasis whose growth or formation is inhibited, or whose size is decreased, or that is eliminated, can be a tumor and/or metastasis in which the microorganisms or cells have accumulated, or also can be a tumor and/or metastasis in which the microorganisms or cells have not accumulated. Accordingly, provided herein are methods of reducing inhibiting tumor growth, inhibiting metastasis growth and/or formation, decreasing the size of a tumor or metastasis, eliminating a tumor or metastasis, or other tumor therapeutic methods, where the method includes administering to a subject a microorganism, where the microorganism or cell accumulates in at least one tumor or metastasis and causes or enhances an anti-tumor response in the subject, and the response also is mounted against a tumor and/or metastasis in which the microorganism or cell did not accumulate. In another embodiment, methods are provided for inhibiting or preventing recurrence of a neoplastic disease or inhibiting or preventing new tumor growth, where the methods include administering to a subject a microorganism or cell that can accumulate in a tumor and/or metastasis, and can cause or enhance an anti-tumor response, and the anti-tumor response can inhibit or prevent recurrence of a neoplastic disease or inhibit or prevent new tumor growth.

Also provided herein are methods for inhibiting tumor growth in a subject, where the methods include administering to a subject a microorganism or cell that can accumulate in a tumor and/or metastasis, and/or can cause lysis of the tumor cells and an immune response is elicited to the lysed tumor components. The anti-tumor immune response induced as a result of lysed tumor components can result in, or enhance, inhibition of tumor growth, shrinkage, and/or elimination of the tumor.

The tumor or neoplastic disease therapeutic methods provided herein, such as methods of reducing inhibiting tumor growth, inhibiting metastasis growth and/or formation, decreasing the size of a tumor or metastasis, eliminating a tumor or metastasis, or other tumor therapeutic methods, also can include administering to a subject a microorganism or cell that can cause tumor cell lysis or tumor cell death, that can bind a ligand that cause tumor cell lysis or tumor cell death, or deplete a vital nutrient from the tumor environment. Such a microorganism or cell can be the same microorganism or cell as the microorganism or cell that can cause or enhance an anti-tumor response in the subject. Microorganisms and cells, such as the microorganisms and cells provided herein, can cause cell lysis or tumor cell death. Additionally, the microorganisms and cells provided herein, can cause cell lysis or tumor cell death as a result of expression of iron sequestration or binding of a compound that sequesters iron or carries a therapeutic agent, expression of a toxin, enzyme, etc.

1. Selection of Bacteria

Bacteria can be used in the methods provided herein. Any of a variety of bacteria possessing the desired characteristics can be used.

It has been determined that facultative aerobic bacteria can survive and grow in tumors. Accordingly, a bacteria used in the methods provided herein can include a bacteria that can survive and grow in an oxygenated environment. A variety of bacteria (facultative aerobic and anaerobic) for use in the methods provided herein are known in the art and include, but are not limited to, *Vibrio* species, *Lactobacillus* species, *Streptococcus* species, *Escherichia species, Listeria species, Salmonella* species, *Clostridium* species, *Shigella* species, and *Bacillus* species. Exemplary bacteria include, but are not limited to *Vibrio cholerae, V. cholerae* CVD-HgR, *Escherichia coli, E. coli* DH5a, *E. coli* Nissle 1917, *Bacillus subtilis, Shigella flexneri,* EIEC, *Streptococcus pyogenes, Listeria monocytogenes, Salmonella typhimurium, Clostridium histolyticus, Clostridium butyricum, Bifodobacterium longum, Bifodobacterium adolescentis, Clavibacter* michiganensis subsp. *michiganensis, Agrobacterium tumefaciens, Erwinia herbicola, Azorhisobium caulinodans, Xanthomonas campestris* pv. *vesicatoria*, and *Xanthomonas campestris* pv. *campestris*. Exemplary bacteria used in the methods provided herein are the *E. coli* Nissle 1917 bacteria (Grozdanov et al. (2004) *Journal of Bacteriology* 186(16): 5432-5441; Nissle 1917 nucleic acid sequence for Genomic Islands I-III: SEQ ID NOS: 12-14)

Bacteria used in the anti-tumor therapies can be modified using any of the techniques described herein. Modified bacteria exhibit one or more enhanced characteristics relative to the wild-type bacteria. Such characteristics can include, but are not limited to, attenuated pathogenicity, decreased or increased toxicity, preferential accumulation in tumor, increased of increased ability to capture, transport or store iron, increased or decreased replication competence, enhanced or reduced capacity to express endogenous polypeptides, ability to express exogenous proteins, ability to induce expression of target genes with an exogenous signal, and combinations thereof. In other embodiments, the bacteria can be further modified to express one or more detectable genes, including genes that can be used for imaging.

The tumor-colonizing capability of a variety of bacteria can be directly measured by injecting bacteria into appropriate tumor-bearing animal models and the tumors assessed for colonization. Additionally, specificity of the bacteria to localize to the tumors compared to non-tumorous tissues can be measured.

2. Administration

In performing the methods provided herein, a microorganism or cell can be administered to a subject, including a subject having a tumor, a metastasis, neoplastic cells, or a subject to be immunized. An administered microorganism or cell can be a microorganism or cell provided herein or any other microorganism or cell known for administration to a subject, for example, any known microorganism or cell known for therapeutic administration to a subject, including antigenic microorganisms such as any microorganism or cell known to be used for vaccination. In some embodiments, the microorganism or cell administered is a microorganism or cell having one or more characteristics including attenuated pathogenicity, low toxicity, preferential accumulation in tumors, increased ability to capture, transport and or store iron, immunogenicity, replication competence, an ability to express or over-express exogenous genes, an ability to over-express endogenous genes, an inactivation/deletion of endogenous genes and an ability to bind ligands.

a. Steps Prior to Administering the Microorganism

In some embodiments, one or more steps can be performed prior to administration of the microorganism or cell to the subject. Any of a variety of preceding steps can be performed, including, but not limited to, diagnosing the subject with a condition appropriate for microorganismal administration, determining the immunocompetence of the subject, immunizing the subject, treating the subject with a chemotherapeutic agent, treating the subject with radiation, or surgically treating the subject.

For embodiments that include administering a microorganism or cell to a tumor-bearing subject for therapeutic purposes, the subject has typically been previously diagnosed with a neoplastic condition. Diagnostic methods also can include determining the type of neoplastic condition, determining the stage of the neoplastic conditions, determining the size of one or more tumors in the subject, determining the presence or absence of metastatic or neoplastic cells in the lymph nodes of the subject, or determining the presence of metastases of the subject. Some embodiments of therapeutic methods for administering a microorganism or cell to a subject can include a step of determination of the size of the primary tumor or the stage of the neoplastic disease, and if the size of the primary tumor is equal to or above a threshold volume, or if the stage of the neoplastic disease is at or above a threshold stage, a microorganism or cell is administered to the subject. In a similar embodiment, if the size of the primary tumor is below a threshold volume, or if the stage of the neoplastic disease is at or below a threshold stage, the microorganism or cell is not yet administered to the subject; such methods can include monitoring the subject until the tumor size or neoplastic disease stage reaches a threshold amount, and then administering the microorganism or cell to the subject. Threshold sizes can vary according to several factors, including rate of growth of the tumor, ability of the microorganism to infect a tumor, and immunocompetence of the subject. Generally the threshold size will be a size sufficient for a microorganism or cell to accumulate and replicate in or near the tumor without being completely removed by the host's immune system, and will typically also be a size sufficient to sustain a microorganismal infection for a time long enough for the host to mount an immune response against the tumor cells, typically about one week or more, about ten days or more, or about two weeks or more. Threshold neoplastic disease stages also can vary according to several factors, including specific requirement for staging a particular neoplastic disease, aggressiveness of growth of the neoplastic disease, ability of the microorganism to infect a tumor or metastasis, and immunocompetence of the subject. Generally the threshold stage will be a stage sufficient for a microorganism to accumulate and replicate in a tumor or metastasis without being completely removed by the host's immune system, and will typically also be a size sufficient to sustain a microorganismal infection for a time long enough for the host to mount an immune response against the neoplastic cells, typically about one week or more, about ten days or more, or about two weeks or more. Exemplary threshold stages are any stage beyond the lowest stage (e.g., Stage I or equivalent), or any stage where the primary tumor is larger than a threshold size, or any stage where metastatic cells are detected.

In another embodiment, the subject can have administered thereto a microorganism or cell without any previous steps of cancer treatment such as chemotherapy, radiation therapy or surgical removal of a tumor and/or metastases. The methods provided herein take advantage of the ability of the microorganisms or cells to enter or localize near a tumor, where the tumor cells can be protected from the subject's immune system; the microorganisms or cells can then proliferate in such an immunoprotected region and can deplete the tumor of iron, or bind a ligand conjugated to a therapeutic agent. Provided herein are methods of treating a tumor, metastases or neoplastic disease in which microorganisms or cells are administered to a subject with a tumor or neoplastic disease without removing the primary tumor, or to a subject with a tumor or neoplastic disease in which at least some tumors or neoplastic cells are intentionally permitted to remain in the subject.

In some cancer treatment methods, such as chemotherapy or radiation therapy, such methods typically have a side effect of weakening the subject's immune system. This treatment of a subject by chemotherapy or radiation therapy can reduce the subject's ability to mount an anti-tumor immune response. Thus, for example, provided herein are methods of treating a tumor or neoplastic disease in which microorganisms or cells are administered to a subject with a tumor or neoplastic disease without treating the subject with an immune system-weakening therapy, such as chemotherapy or radiation therapy.

In an alternative embodiment, prior to administration of a microorganism or cell to the subject, the subject can be treated in one or more cancer treatment steps that do not remove the primary tumor or that do not weaken the immune system of the subject. A variety of more sophisticated cancer treatment methods are being developed in which the tumor can be treated without surgical removal or immune-system weakening therapy. Exemplary methods include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound. Thus, combined methods that include administering a microorganism or cell to a subject can further improve cancer therapy. Thus, provided herein are methods of administering a microorganism or cell to a subject, along with prior to or subsequent to, for example, administering a compound that slows tumor growth without weakening the subject's immune system or a compound that inhibits vascularization of the tumor.

b. Mode of Administration

Any mode of administration of a microorganism or cell to a subject can be used, provided the mode of administration permits the microorganism or cell to enter a tumor or metastasis. Modes of administration can include, but are not limited to, intravenous, intraperitoneal, subcutaneous, intramuscular, topical, intratumor, multipuncture (e.g., as used with smallpox vaccines), inhalation, intranasal, oral, intracavity (e.g., administering to the bladder via a catheter, administering to the gut by suppository or enema), aural, ocular, transdermal, subcutaneous, intra-arterial (e.g. hepatic artery infusion), intravesicular perfusion, or intrapleural administration. One skilled in the art can select any mode of administration compatible with the subject and the microorganism, and that also is likely to result in the microorganism or cell reaching tumors and/or metastases. The route of administration can be selected by one skilled in the art according to any of a variety of factors, including the nature of the disease, the kind of tumor, and the particular microorganism or cell contained in the pharmaceutical composition. Administration to the target site can be performed, for example, by ballistic delivery, as a colloidal dispersion system, or systemic administration can be performed by injection into an artery, such as the hepatic artery.

c. Dosage

The dosage regimen can be any of a variety of methods and amounts, and can be determined by one skilled in the art according to known clinical factors. Dosages can be determined empirically by the amount needed to produce a detectable signal or amount to effect a physiological response. As is known in the medical arts, dosages for any one patient can depend on many factors, including the subject's species, size, body surface area, age, sex, immunocompetence, and general health, the particular microorganism or cell to be administered, duration and route of administration, the kind and stage of the disease, for example, tumor size, and other compounds such as drugs being administered concurrently. Exemplary routes of administration, such as topical, local, or systemic administration can differ in the dosage given. For example, dosages for injections intravenously, intraperitoneally, or intratumorally can differ. Thus, dosages delivered directly into a tumor (i.e. intratumoral injection) can be administered at lower effective dosages. In addition to the above factors, such levels can be affected by the infectivity of the microorganism, and the nature of the microorganism, as can be determined by one skilled in the art. At least some of the viruses used the in the methods provided herein can be more infectious than the bacteria used herein. Thus, in some embodiments of the present methods, virus can be administered at lower levels than bacteria. In the present methods, appropriate minimum dosage levels of microorganisms or cells can be levels sufficient for the microorganism or cell to survive, grow and replicate in a tumor or metastasis. Appropriate maximum dosage levels of microorganisms or cells can be levels that are not toxic to the host, levels that do not cause splenomegaly of 3× or more, levels that do not result in colonies or plaques in normal tissues or organs after about 1 day or after about 3 days or after about 7 days. Exemplary levels for administering a bacterium to a 65 kg human can include $1\times10^3$ or about $1\times10^3$ cfu colony forming units (cfu), $1\times10^4$ or about $1\times10^5$ cfu, $1\times10^4$ or about $1\times10^5$ cfu, $1\times10^6$ or about $1\times10^6$ cfu, $1\times10^7$ or about $1\times10^7$ cfu, $5\times10^7$ or about $5\times10^7$ cfu, $1\times10^8$ or about $1\times10^8$ cfu, $1\times10^9$ or about $1\times10^9$ cfu, $1\times10^{10}$ or about $1\times10^{10}$ pfu, $5\times10^{10}$ or about $5\times10^{10}$ pfu, $1\times10^{11}$ or about $1\times10^{11}$ pfu, $5\times10^{11}$ or about $5\times10^{11}$ cfu, or more cfu. Dosages injected intratumorally can be lower, for example, 100 cfu or more. Exemplary dosages for administering a virus to a 65 kg human can include $5\times10^5$ or about $5\times10^5$ plaque forming units (pfu), $1\times10^6$ or about $1\times10^6$ pfu, $5\times10^6$ or about $5\times10^6$ pfu, $1\times10^7$ or about $1\times10^7$ pfu, $1\times10^8$ or about $1\times10^8$ pfu, $1\times10^9$ pfu or about $1\times10^9$ pfu, $5\times10^9$ or about $5\times10^9$ pfu, $1\times10^{10}$ or about $1\times10^{10}$ pfu, or $5\times10^{10}$ or about $5\times10^{10}$ pfu, or more pfu.

d. Number of Administrations

The methods provided herein can include a single administration of a microorganism or cell to a subject or multiple administrations of a microorganism or cell to a subject. In some embodiments, a single administration is sufficient to establish a microorganism or cell in a tumor, where the microorganism or cell can proliferate and can cause or enhance an anti-tumor response in the subject; such methods do not require additional administrations of a microorganism or cell in order to cause or enhance an anti-tumor response in a subject, which can result, for example in inhibition of tumor growth, inhibition of metastasis growth or formation, reduction in tumor or metastasis size, elimination of a tumor or metastasis, inhibition or prevention of recurrence of a neoplastic disease or new tumor formation, or other cancer therapeutic effects. In other embodiments, a microorganism or cell can be administered on different occasions, separated in time, typically, by at least one day. Separate administrations can increase the locations on a tumor or metastasis where microorganism or cell proliferation can occur or can otherwise increase the titer of microorganism or cell accumulated in the tumor, and also can, optionally, increase the level of microorganism-based tumor lysis or tumor cell death. Separate administrations of a microorganism or cell can further extend a subject's immune response against microorganismal antigens, which can extend the host's immune response to tumors or metastases in which microorganisms or cells have accumulated, and can increase the likelihood a host mounting an anti-tumor immune response.

When separate administrations are performed, each administration can be a dosage amount that is the same or different relative to other administration dosage amounts. In one embodiment, all administration dosage amounts are the same. In other embodiments, a first dosage amount can be a larger dosage amounts than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, smaller amount relative to the first administration.

Separate administrations can include any number of two or more administrations, including two, three, four, five or six administrations. One skilled in the art can readily determine the number of administrations to perform or the desirability of performing one or more additional administrations according to methods known in the art for monitoring therapeutic methods and other monitoring methods provided herein. Accordingly, the methods provided herein include methods of providing to the subject one or more administrations of a microorganism, where the number of administrations can be determined by monitoring the subject, and, based on the results of the monitoring, determining whether or not to provide one or more additional administrations. Deciding of whether or not to provide one or more additional administrations can be based on a variety of monitoring results, including, but not limited to, indication of tumor growth or inhibition of tumor growth, appearance of new metastases or inhibition of metastasis, the subject's anti-microorganism or cell antibody titer, the subject's anti-tumor antibody titer, the overall health of the subject, the weight of the subject, the presence of microorganism or cell solely in tumor and/or metastases, the presence of microorganism or cell in normal tissues or organs.

The time period between administrations can be any of a variety of time periods. The time period between administrations can be a function of any of a variety of factors, including monitoring steps, as described in relation to the number of administrations, the time period for a subject to mount an immune response, the time period for a subject to clear microorganism or cell from normal tissue, or the time period for microorganismal proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear microorganism or cell from normal tissue; for example, the time period can be more than the time period for a subject to clear microorganism or cell from normal tissue, such as more than about a day, more than about two days, more than about three days, more than about five days, or more than about a week. In another example, the time period can be a function of the time period for microorganismal proliferation in the tumor or metastasis; for example, the time period can be more than the amount of time for a detectable signal to arise in a tumor or metastasis after administration of a microorganism or cell expressing a detectable marker, such as about 3 days, about 5 days, about a week, about ten days, about two weeks, or about a month.

3. Co-Administrations

Also provided are methods in which an additional therapeutic substance, such as a different therapeutic microorganism or cell or a therapeutic compound is administered. In some embodiments, the additional therapeutic substance is, for example, a siderophore, an antibody, a peptide, a protein (e.g., lactoferrin, transferrin, etc.), a molecule for induction of gene expression (e.g., arabinose), a nanoparticle, another therapeutic microorganism or cell or any other compound provided herein that can be administered as a therapeutic composition. These can be administered simultaneously, sequentially or intermittently with the first microorganism. The additional therapeutic substance can interact with the microorganism or cell or a gene product thereof, or the additional therapeutic substance can act independently of the microorganism. Any mode of administration of a microorganism or cell to a subject can be used, provided the mode of administration permits the microorganism or cell to enter a tumor or metastasis.

Modes of administration for a co-administered substance can be the same mode of administration as the microorganism or cell or can be via a different mode of administration. Modes of administration can include, but are not limited to, intravenous, intraperitoneal, subcutaneous, intramuscular, topical, intratumor, multipuncture, inhalation, intranasal, oral, intracavity (e.g., administering to the bladder via a catheter, administering to the gut by suppository or enema), aural, ocular, transdermal, subcutaneous, intra-arterial (e.g. hepatic artery infusion), intravesicular perfusion, or intrapleural administration. One skilled in the art can select any mode of administration compatible with the subject and the microorganism or cell, and that also is likely to result in the co-administered substance reaching the microorganism or cell or tumors and/or metastases. The route of administration can be selected by one skilled in the art according to any of a variety of factors, including the nature of the disease, the kind of tumor, and the particular microorganism or cell contained in the pharmaceutical composition. Administration to the target site can be performed, for example, by ballistic delivery, as a colloidal dispersion system, or systemic administration can be performed by injection into an artery, such as the hepatic artery. In one non-limiting example provided herein a co-administered molecule, such as arabinose for the induction of gene expression, is administered by intravenous injection or provided orally.

a. Other Therapeutic Agents, Compounds and Gene Products

The methods can include administering one or more therapeutic compounds to the subject in addition to administering a microorganism or cell or plurality thereof to a subject. Therapeutic compounds can act independently, or in conjunction with the microorganism, for tumor therapeutic affects. Therapeutic compounds that can act independently include any of a variety of known chemotherapeutic compounds that can inhibit tumor growth, inhibit metastasis growth and/or formation, decrease the size of a tumor or metastasis, eliminate a tumor or metastasis, without reducing the ability of a microorganism or cell to accumulate in a tumor, replicate in the tumor, and cause or enhance an anti-tumor immune response in the subject.

Therapeutic compounds that act in conjunction with the microorganisms or cells include, for example, compounds that alter the expression of the microorganism or cell or compounds that can interact with a microorganism-expressed gene and/or gene product, or compounds that can inhibit microorganismal proliferation, including compounds toxic to the microorganism. Therapeutic compounds that can act in conjunction with the microorganism or cell include, for example, therapeutic compounds that increase the proliferation, toxicity, tumor cell killing, or immune response eliciting properties of a microorganism, and also can include, for example, therapeutic compounds that decrease the proliferation, toxicity, immune response-eliciting, or cell killing properties of a microorganism. Thus, provided herein are methods of administering to a subject one or more therapeutic compounds that can act in conjunction with the microorganism or cell to increase the proliferation, toxicity, tumor cell killing, or immune response eliciting properties of a microorganism. Also provided herein are methods of administering to a subject one or more therapeutic compounds that can act in conjunction with the microorganism or cell to decrease the proliferation, toxicity, immune response-eliciting, or cell killing properties of a microorganism.

Also provided herein are pharmaceutical compositions containing a microorganism or cell as described above, wherein the microorganism or cell furthermore contains one or more expressible DNA sequence(s) encoding (a) protein(s) or a functional RNA suitable for tumor therapy and/or elimination of metastatic tumors, such as a cytotoxic protein, a cytostatic protein, a protein inhibiting angiogenesis, or a protein stimulating apoptosis. Such proteins are well-known to the person skilled in the art. Exemplary therapeutic proteins include, but are not limited to, a cell-surface receptor, a cytokine, a chemokine, an apoptotic protein, an antimitotic oligopeptide, a toxin, a tumor antigen, a prodrug converting enzyme), an RNA (e.g., ribozyme, RNAi, siRNA), or a compound that is generated by an encoded polypeptide and, in some examples, the cellular machinery of the tumor or immunoprivileged tissue or cells (e.g., a metabolite, a converted prodrug).

Therapeutic agents that can be administered to the subject in addition to administering a microorganism or cell or plurality thereof to a subject can be, for example, an anti-cancer agents including, but are not limited to, cytokines, growth factors, photosensitizing agents, radionuclides, toxins, antimetabolites, signaling modulators, anti-cancer antibiotics, anti-cancer antibodies, angiogenesis inhibitors, radiation therapy, chemotherapeutic compounds, or a combination thereof.

Exemplary cytokines and growth factors include, for example, interleukins, such as interleukin-1, interleukin-2, interleukin-6 and/or interleukin-12, tumor necrosis factors, such as tumor necrosis factor alpha (TNF-α), interferons such as interferon gamma (IFN-γ), granulocyte macrophage colony stimulating factor (GM-CSF), angiogenins, and a tissue factors.

Exemplary photosensitizing agents include, for example, indocyanine green, toluidine blue, aminolevulinic acid, texaphyrins, benzoporphyrins, phenothiazines, phthalocyanines, porphyrins, such as sodium porfimer, chlorins, such as tetra (m-hydroxyphenyl)chlorin or tin(IV) chlorin e6, purpurins, such as tin ethyl etiopurpurin, purpurinimides, bacteriochlorins, pheophorbides, a pyropheophorbides and cationic dyes.

Exemplary radionuclides include, for example, $^{11}$Carbon, $^{11}$Fluorine, $^{13}$Carbon, $^{13}$Nitrogen, $^{15}$Nitrogen, $^{15}$Oxygen, $^{18}$Fluorine, $^{19}$Fluorine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttrium, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium $^{186}$Rhenium, $^{188}$Rhenium, $^{192}$Iridium, $^{198}$Gold, $^{201}$Thallium, $^{211}$Astatine, $^{212}$Bismuth or $^{213}$Bismuth.

Exemplary toxins include, for example, 5-fluorouridine, calicheamicin and maytansine.

Exemplary anti-metabolites include, for example, methotrexate, 5-fluorouracil, 6-mercaptopurine, cytosine arabinoside, hydroxyurea, and 20-chlorodeoxyadenosine.

Exemplary signaling modulators include, for example, an inhibitors of macrophage inhibitory factor, a toll-like receptor agonists and stat 3 inhibitors.

Exemplary anti-cancer antibiotics include, for example, anthracyclines, pleomycins, such as pleomycin and peplomycin sulfate, mitomycins such as mitomycin C, actinomycins such as actinomycin D, zinostatinstimalamer, polypeptides such as neocarzinostatin, and anthracyclines, such as doxorubicin hydrochloride (adriamycin), idarubicin hydrochloride, daunorubicin hydrochloride, aclarubicin Hydrochloride, epirubicin hydrochloride, and purarubicin hydrochloride.

Exemplary anti-cancer antibodies include, for example, Rituximab (RITUXAN), ADEPT, Trastuzumab (HERCEPTIN), Tositumomab (BEXXAR), Cetuximab (ERBITUX), Ibritumomab (90Y-Ibritumomab tiuexetan; ZEVALIN), Alemtuzumab (Campath-1H), Epratuzumab (Lymphocide), Gemtuzumab ozogamicin (MYLOTARG), Bevacimab (AVASTIN), and Edrecolomab (PANOREX).

Exemplary angiogenesis inhibitors include, for example, collagenase inhibitors such as metalloproteinases and tetracyclines such as minocycline, naturally occurring peptides such as endostatin and angiostatin, fungal and bacterial derivatives, such as fumagillin derivatives like TNP-470, aptamer antagonist of VEGF batimastat, Captopril, cartilage derived inhibitor (CDI), genistein, interleukin 12 Lavendustin A, medroxyprogesterone acetate, recombinant human platelet factor 4(rPF4), taxol, D-gluco-D-galactan sulfate (Tecogalan(=SP-PG, DS-4152)), thalidomide, thrombospondin.

Exemplary radiation therapy includes, but is not limited to, photodynamic therapy, radionuclides, radioimmunotherapy and proton beam treatment.

Exemplary chemotherapeutic compounds provided herein are Erlotinib (Tarceva); sunitinib malate (SUTENT); alkylating agents such as thiotepa and cyclosphosphamide; alkyl sulfonates such as busulfan, improsulfan and piposulfan; aziridines such as benzodopa, carboquone, meturedopa and uredopa; ethylenimines and methylamelamines including altretamine, triethylenemelamine, trietylenephosphoramide, triethylenethiophosphaoramide and trimethylolomelamine nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenishers such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; polysaccharide-K; razoxane; sizofuran; spirogermanium; tenuazonic acid; triaziquone; 2, 2',2"-trichlorotriethylamine; urethan; vindesine; dacarbazine; mannomustine; mitobronitol; mitolactol; pipobroman; gacytosine; cytosine arabinoside; cyclophosphamide; thiotepa; taxoids, e.g. paclitaxel and doxetaxel; chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT11; topoisomerase inhibitor RFS 2000; difluoromethylornithine (DMFO); retinoic acid; esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (Fareston); and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods. Particular exemplary platinum coordination complexes include, but are not limited to, cisplatin, carboplatin and oxaliplatin.

In other embodiments, the microorganism or cell can express a protein that converts a less active compound into a compound that causes tumor cell death. The protein can be an enzyme converting an inactive substance (pro-drug) administered to the organism into an active substance, i.e. toxin, which kills the tumor or metastasis. Exemplary methods of conversion of such a prodrug compound include enzymatic conversion and photolytic conversion. For example, the enzyme can be glucuronidase converting the less toxic form of the chemotherapeutic agent glucuronyldoxorubicin into a more toxic form. Exemplary prodrugs include, but are not limited to, 5-fluorouracil, gancyclovir, 6-methylpurine deoxyriboside, cephalosporin-doxorubicin, 4-[(2-chloroethyl)(2-mesuloxyethyl)amino]benzoyl-L-glutamic acid, indole-3-acetic acid, 7-ethyl-10-[4-(1-piperidino)-1-piperidino]carbonyloxycampotothecin, bis-(2-chloroethyl)amino-4-hydroxyphenylaminomethanone 28,1-chloromethyl-5-hydroxy-1,2-dihydro-3H-benz[e]indole, epirubicin-glucoronide, 5'-deoxy5-fluorouridine, cytosine arabinoside, and linamarin. A large variety of protein/prodrug compound pairs are known in the art, and include, but are not limited to, Herpes simplex virus thymidine kinase/gancyclovir, varicella zoster thymidine kinase/gancyclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl)(2-mesuloxyethyl)amino]benzoyl-L-glutamic acid, cytochrome P450/acetominophen, horseradish peroxidase/indole-3-acetic acid, nitroreductase/CB1954, rabbit carboxylesterase/7-ethyl-10-[4-(1-piperidino)-1-piperidino]carbonyloxycampotothecin, mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin-glucoronide, thymidine phosphorylase/5'-deoxy5-fluorouridine, deoxycytidine kinase/cytosine arabinoside, beta-lactamase and linamerase/linamarin.

In a particular example, the gene encoding the prodrug converting enzyme is directed by a promoter which is inducible additionally ensuring that the conversion of the pro-drug into the toxin only occurs in the target tissue, i.e. tumor. Such promoters include, for example, IPTG-, antibiotic-, heat-, pH-, light-, metal-, aerobic-, host cell-, drug-, cell cycle-, sugar (e.g., arabinose, xylose, etc.) or tissue specific-inducible promoters.

Additional examples of suitable therapeutic proteins are human endostatin and the chimeric PE37/TGF-alpha fusion protein. Endostatin is a carboxyterminal peptide of collagen XVIII which has been characterized (Ding et al., *PNAS USA* 95: 10443 (1998)). It has been shown that endostatin inhibits endothelial cell proliferation and migration, induces G1 arrest and apoptosis of endothelial cells in vitro, and has anti-tumor effect in a variety of tumor models. Intravenous or intramuscular injection of viral DNA and cationic liposome-complexed plasmid DNA encoding endostatin result in limited expression levels of endostatin in tumors. However intratumoral injection of purified endostatin shows remarkable inhibition of tumor growth. *Pseudomonas* exotoxin (PE) is a bacterial toxin secreted by *Pseudomonas aeruginosa*. PE elicits its cytotoxic effect by inactivating elongation factor 2 (EF-2), which results in blocking of protein synthesis in mammalian cells. Single chain PE is functionally divided into three domains: domain Ia is required for binding to cell surface receptor, domain II is required for translocating the toxin into the target cell cytosol, and domain III is responsible for cytotoxicity by inactivating EF-2. PE40 is derived from wild type *Pseudomonas* exotoxin that lacks the binding domain Ia. Other proteins such as antibody fragments or protein ligands can be inserted in place of the binding domain. This will render the PE40-ligand fusion protein specific to its receptor. One of the highly specific engineered chimeric toxins is the TGF alpha/PE40 fusion protein, where the C-terminus of TGF alpha polypeptide has been fused in frame with the N-terminus of the PE40 protein. TGF alpha is one of the ligands of epidermal growth factor receptor (EGFR), which has been shown to be preferentially expressed on the surface of a variety of tumor cells. TGF alpha-PE40 fusion protein has been shown to be highly toxic to tumor cells with elevated EGFRs on the cell surface and while it is less toxic to nearby cells displaying fewer numbers of surface EGFR. The toxicity of TGF alpha-PE40 chimeric protein is dependent on a proteolytic processing step to convert the chimeric protein into its active form, which is carried out by the target. To overcome the requirement for proteolysis, a new chimeric toxin protein that does not require processing has been constructed by Theuer et al. (*J. Biol. Chem.* 267: 16872 (1992)). The novel fusion protein is termed PE37/TGF alpha, which exhibited higher toxicity to tumor cells than the TGF alpha-PE40 fusion protein. Thus, in one embodiment of the pharmaceutical composition, the protein suitable for tumor therapy is endostatin (for inhibition of tumor growth) or recombinant chimeric toxin PE37/transforming growth factor alpha (TGF-alpha) (for cytotoxicity to tumor cells).

Moreover, the delivery system of the present application even allows the application of compounds which could so far not be used for tumor therapy due to their high toxicity when systemically applied. Such compounds include proteins inhibiting elongation factors, proteins binding to ribosomal subunits, proteins modifying nucleotides, nucleases, proteases or cytokines (e.g., IL-2, IL-12 etc.), since experimental data suggest that the local release of cytokines might have a positive effect on the immunosuppressive status of the tumor.

b. Therapeutic Gene Product Expression

The microorganisms and cells provided herein can express one or more genes whose products cause cell death or whose products cause an anti-tumor immune response; such genes can be considered therapeutic genes. A variety of therapeutic gene products, such as toxic or apoptotic proteins, or siRNA, are known in the art, and can be used with the viruses provided herein. The therapeutic genes can act by directly killing the host cell, for example, as a channel-forming or other lytic protein, or by triggering apoptosis, or by inhibiting essential cellular processes, or by triggering an immune response against the cell, or by interacting with a compound that has a similar effect, for example, by converting a less active compound to a cytotoxic compound. A large number of therapeutic proteins that can be expressed for tumor treatment are known in the art, including, but not limited to, tumor suppressors, toxins, cytostatic proteins, and costimulatory molecules such as cytokines and chemokines. Costimulatory molecules for the methods provided herein include any molecules which are capable of enhancing immune responses to an antigen/pathogen in vivo and/or in vitro. Costimulatory molecules also encompass any molecules which promote the activation, proliferation, differentiation, maturation, or maintenance of lymphocytes and/or other cells whose function is important or essential for immune responses. An exemplary, non-limiting list of therapeutic proteins includes WT1, p53, p16, Rb, BRCA1, cystic fibrosis transmembrane regulator (CFTR), Factor VIII, low density lipoprotein receptor, beta-galactosidase, alpha-galactosidase, beta-glucocerebrosidase, insulin, parathyroid hormone, alpha-1-antitrypsin, rsCD40L, Fas-ligand, TRAIL, TNF, antibodies, microcin E492, diphtheria toxin, *Pseudomonas* exotoxin, *Escherichia coli* Shig toxin, *Escherichia coli* Verotoxin 1, and hyperforin. Exemplary cytokines include, but are not limited to, chemokines and classical cytokines, such as the interleukins, including for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factor (GM-CSF) and exemplary chemokines including, but not limited to CXC chemokines such as IL-8 GROα, GROβ, GROγ, ENA-78, LDGF-PBP, GCP-2, PF4, Mig, IP-10, SDF-1α/β, BUNZO/STRC33, I-TAC, BLC/BCA-1; CC chemokines such as MIP-1α, MIP-1β, MDC, TECK, TARC, RANTES, HCC-1, HCC-4, DC-CK1, MIP-3α, MIP-3β, MCP-1, MCP-2, MCP-3, MCP-4, Eotaxin, Eotaxin-2/MPIF-2, I-309, MIP-5/HCC-2, MPIF-1, 6Ckine, CTACK, MEC; lymphotactin; and fractalkine. Exemplary other costimulatory molecules include immunoglobulin superfamily of cytokines, such as B7.1, B7.2.

In other embodiments, the viruses can express a protein that converts a less active compound into a compound that causes tumor cell death. Exemplary methods of conversion of such a prodrug compound include enzymatic conversion and photolytic conversion. A large variety of protein/compound pairs are known in the art, and include, but are not limited to, Herpes simplex virus thymidine kinase/ganciclovir, Herpes simplex virus thymidine kinase/(E)-5-(2-bromovinyl)-2'-deoxyuridine (BVDU), varicella zoster thymidine kinase/ganciclovir, varicella zoster thymidine kinase/BVDU, varicella zoster thymidine kinase/(E)-5-(2-bromovinyl)-1-beta-D-arabinofuranosyluracil (BVaraU), cytosine deaminase/5-fluorouracil, cytosine deaminase/5-fluorocytosine, purine nucleoside phosphorylase/6-methylpurine deoxyriboside, beta lactamase/cephalosporin-doxorubicin, carboxypeptidase G2/4-[(2-chloroethyl)(2-mesuloxyethyl)amino]benzoyl-L-glutamic acid (CMDA), carboxypeptidase A/methotrexate-phenylamine, cytochrome P450/acetominophen, cytochrome P450-2B1/cyclophosphamide, cytochrome P450-4B1/2-aminoanthracene, 4-ipomeanol, horseradish peroxidase/indole-3-acetic acid, nitroreductase/CB1954, rabbit carboxylesterase/7-ethyl-10-[4-(1-piperidino)-1-piperidino]carbonyloxycamptothecin (CPT-11), mushroom tyrosinase/bis-(2-chloroethyl)amino-4-hydroxyphenylaminomethanone 28, beta galactosidase/1-chloromethyl-5-hydroxy-1,2-dihydro-3H-benz[e]indole, beta glucuronidase/epirubicin glucuronide, thymidine phosphorylase/5'-deoxy-5-fluorouridine, deoxycytidine kinase/cytosine arabinoside, and linamerase/linamarin.

In another embodiment, the therapeutic gene product can be an siRNA molecule. The siRNA molecule can be directed against expression of a tumor-promoting gene, such as, but not limited to, an oncogene, growth factor, angiogenesis promoting gene, or a receptor. The siRNA molecule also can be directed against expression of any gene essential for cell growth, cell replication or cell survival. The siRNA molecule also can be directed against expression of any gene that stabilizes the cell membrane or otherwise limits the number of tumor cell antigens released from the tumor cell. Design of an siRNA can be readily determined according to the selected target of the siRNA; methods of siRNA design and down-regulation of genes are known in the art, as exemplified in U.S. Pat. Pub. No. 2003-0198627.

In another embodiment, the therapeutic gene product can be a viral attenuation factor. Antiviral proteins or peptides can be expressed by the viruses provided herein. Expression of antiviral proteins or peptides can control viral pathogenicity. Exemplary viral attenuation factors include, but are not limited to, virus-specific antibodies, mucins, thrombospondin, and soluble proteins such as cytokines, including, but not limited to TNFα, interferons (for example IFNα, IFNβ, or IFNγ) and interleukins (for example IL-1, IL-12 or IL-18).

In another embodiment, the therapeutic gene product can be a protein ligand, such as antitumor oligopeptide. Antitumor oligopeptides are short protein peptides with high affinity and specificity to tumors. Such oligopeptides could be enriched and identified using tumor-associated phage libraries (Akita et al. (2006) *Cancer Sci.* 97(10):1075-1081). These oligopeptides have been shown to enhance chemotherapy (U.S. Pat. No. 4,912,199). The oligopeptides can be expressed by the viruses provided herein. Expression of the oligopeptides can elicit anticancer activities on their own or in combination with other chemotherapeutic agents. An exemplary group of antitumor oligopeptides is antimitotic peptides, including, but not limited to, tubulysin (Khalil et al. (2006) *Chembiochem.* 7(4):678-683), phomopsin, hemiasterlin, taltobulin (HTI-286, 3), and cryptophycin. Tubulysin is from myxobacteria and can induce depletion of cell microtubules and trigger the apoptotic process. The antimitotic peptides can be expressed by the viruses provide herein and elicit anticancer activities on their own or in combination with other therapeutic modalities.

In one embodiment, the therapeutic compound can be controlled by a regulatory sequence. Suitable regulatory sequences which, for example, are functional in a mammalian host cell are well known in the art. In one example, the regulatory sequence can contain a natural or synthetic promoter. Such promoters include, for example, IPTG-, antibiotic-, heat-, pH-, light-, metal-, aerobic-, host cell-, drug-, cell cycle-, sugar (e.g., arabinose, xylose, etc.) or tissue specific-inducible promoters.

4. State of Subject

In another embodiment, the methods provided herein for administering a microorganism or cell to a subject can be performed on a subject in any of a variety of states, including an anesthetized subject, an alert subject, a subject with elevated body temperature, a subject with reduced body temperature, or other state of the subject that is known to affect the accumulation of microorganism or cell in the tumor. It has been determined that a subject that is anesthetized can have a decreased rate of accumulation of a microorganism or cell in a tumor relative to a subject that is not anesthetized. Accordingly, provided herein are methods of administering a microorganism or cell to a subject, where the methods can include administering a microorganism or cell to a subject where the subject is not under general anesthesia. For example, the subject can be under local anesthesia, or can be unanesthetized. It has been determined that a subject with decreased body temperature can have a decreased rate of accumulation of a microorganism or cell in a tumor relative to a subject with a normal body temperature. Accordingly, provided herein are methods of administering a microorganism or cell to a subject, where the methods can include administering a microorganism or cell to a subject with altered body temperature, where the alteration of the body temperature can influence the ability of the microorganism or cell to accumulate in a tumor; typically, a decrease in body temperature can decrease the ability of a microorganism or cell to accumulate in a tumor. Thus, in one exemplary embodiment, a method is provided for administering a microorganism or cell to a subject, where the method includes elevating the body temperature of the subject to a temperature above normal, and administering a microorganism or cell to the subject, where the microorganism or cell can accumulate in the tumor more readily in the subject with higher body temperature relative to the ability of the microorganism or cell to accumulate in a tumor of a subject with a normal body temperature.

5. Monitoring Tumor Size

Also provided herein are methods of monitoring tumor and/or metastasis size and location. Tumor and or metastasis size can be monitored by any of a variety of methods known in the art, including external assessment methods or tomographic or magnetic imaging methods. In addition to the methods known in the art, methods provided herein, for example, monitoring microorganismal gene expression, can be used for monitoring tumor and/or metastasis size.

Monitoring size over several time points can provide information regarding the increase or decrease in size of a tumor or metastasis, and can also provide information regarding the presence of additional tumors and/or metastases in the subject. Monitoring tumor size over several time points can provide information regarding the development of a neoplastic disease in a subject, including the efficacy of treatment of a neoplastic disease in a subject.

6. Monitoring General Health Diagnostics

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering a microorganism or cell to a subject. Monitoring the health of a subject can be used to determine the pathogenicity of a microorganism or cell administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, c-reactive protein concentration.

H. ENRICHMENT

Recombinantly engineered bacteria can be enriched from a mixed culture prior to use in any of the methods provided herein. Enrichment can occur by selecting for the recombinant feature, such as, for example, a metabolic feature, a marker, such as antibiotic resistance, a cell surface molecule that can be used as a ligand, or an intracellular protein that can be used as a ligand, using techniques known in the art. Any combination of recombinant engineering can be applied to distinguish between bacteria carrying the target gene of interest and those bacteria which were not successfully engineered using methods known in the art.

Bacteria that express antibiotic resistance cassettes and metabolic markers can be enriched from mixed cultures using techniques, such as, but not limited to, culture in liquid broth or on agar plates carrying the antibiotic. Bacteria can be re-cultured until the desired level of enrichment is obtained. Typically, approximately 50%, 55%, 60%, 65%, 70%, 75%, 80%, 85%, 90%, or 95% is achievable. An exemplary enrichment of 95% or more is achievable.

Bacteria that express ligands on their cell surface can be enriched from mixed cultures using techniques such as, but not limited to, magnetic separation techniques. For example, the bacteria can be engineered to carry a recombinant gene, e.g., a recombinant outer membrane protein (OmpA) with a streptavidin binding peptide (SA-B) gene (also encoding a signal peptide for cell surface expression). Expression of the SA-B/OmpA complex will mark these recombinant bacteria for binding by a streptavidin conjugate, and therefore, enrichment. The bacteria also can, optionally, be further recombinantly engineered with a detectable gene, such as the lux operon, that allows for analysis of the recombinant bacteria versus non-recombinant bacteria in a resulting enriched culture. Bacteria are suspended in solution, ligand-coated (e.g., streptavidin-coated) nanoparticles are added and a magnetic field is applied. The proportion of recombinant bacteria in the mixture compared to non-recombinant bacteria can be determined using methods known in the art. For example, after removal of the magnet with the bound bacteria from the culture, the magnetic field can be removed and the enriched bacteria cultured. To determine the level of enrichment, the luciferase expressing bacteria can be counted to obtain the proportion of SA-B-expressing bacteria. The magnetic field can be reapplied until the desired level of enrichment is obtained. Typically, approximately 50%, 55%, 60%, 65%, 70%, 75%, 80%, 85%, 90%, or 95% is achievable. An exemplary enrichment of 95% or more is achievable.

Bacteria that express recombinant intracellular proteins (e.g., ferritin-like compounds) can be enriched from mixed cultures using techniques, such as, but not limited to, intracellular FACS analysis using methods known in the art. Bacteria can, optionally, be further recombinantly engineered with an antibiotic resistance cassette as described above, and the bacteria cultured in the presence of the antibiotic. Bacteria are cultured, and a small aliquot is removed, fixed, optionally perforated and analyzed by FACS analysis. Bacteria can be re-cultured until the desired level of enrichment is obtained. Typically, approximately 50%, 55%, 60%, 65%, 70%, 75%, 80%, 85%, 90%, or 95% is achievable. An exemplary enrichment of 95% or more is achievable.

Enrichment techniques as provided herein and the Examples can be applied to any of the recombinant bacteria provided herein based on the specific recombinant protein/peptide and the corresponding ligand or an antibody that specifically binds the specific recombinant protein/peptide. Techniques for identifying intracellular proteins/markers are known in the art, such as, for example, FACS analysis of fixed, perforated cells, SDS-PAGE, Western blotting, etc.

The enriched bacteria can be injected into a subject. Optionally, prior to injection, the enriched bacteria also can be further recombinantly modified and enriched based on an additional selection marker.

The enriched bacteria can be used in any of the diagnostic, imaging, or therapy methods provided herein.

I. PHARMACEUTICAL COMPOSITIONS, COMBINATIONS AND KITS

1. Pharmaceutical Compositions

Provided herein are pharmaceutical compositions, combinations and kits containing any of the microorganism or cell provided herein. Pharmaceutical compositions provided herein can be used for in vivo for diagnostic or therapeutic purposes and can be formulated in any conventional manner by mixing a selected amount of the polypeptide with one or more physiologically/pharmaceutically acceptable carriers or excipients. Selection of the carrier or excipient is within the skill of the administering individual/professional and can depend upon a number of parameters. These include, for example, the mode of administration (e.g., systemic, intraperitoneal, subcutaneous, oral, nasal, pulmonary, local, topical or any other mode) and disorder treated. The pharmaceutical compositions provided herein can be formulated for single dosage or multiple dosage administration or for dilution or other modification. The concentrations of the compounds in the formulations are effective for delivery of an amount, upon administration, that is effective for the intended treatment and individual. The compositions can be formulated for single dosage administration or for a plurality of dose administrations. Administrations can be concomitant or sequential. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

Examples of suitable pharmaceutical carriers are known in the art and include phosphate buffered saline solutions, water, emulsions, such as oil/water emulsions, various types of wetting agents, sterile solutions, etc. Such carriers can be formulated by conventional methods and can be administered to the subject at a suitable dose.

In an exemplary embodiment, microorganisms and cells provided herein are formulated as pharmaceutical compositions and can, optionally, include a variety of pharmaceutically acceptable excipients or pharmaceutically suitable pharmaceutical carriers. Siderophores, antibodies, peptides, proteins, molecules for induction of gene expression (e.g., arabinose), and nanoparticles provided herein also can be formulated as pharmaceutical compositions, and can be formulated in the same or different pharmaceutical composition as the microorganisms and cells.

The microorganisms and cells can be formulated as the sole pharmaceutically active ingredient in the composition or can be combined with other ingredients. The active compound is included in the pharmaceutically acceptable carrier in an amount sufficient to exert a therapeutically useful effect in the absence of undesirable side effects on the subject treated; or to be present in sufficient amounts to allow for detection using the methods described herein. The therapeutically effective concentration can be determined empirically by testing the compounds in known in vitro and in vivo systems, such as the assays provided herein. The active compounds can be administered by any appropriate route, for example, intraperitoneal, parenteral, intravenous, intradermal, subcutaneous or topical administration, in liquid, semi-liquid or solid form and are formulated in a manner suitable for each route of administration.

The concentration of active compound in the composition depends on absorption, inactivation and excretion rates of the active compound, the dosage schedule, and amount administered as well as other factors known to those of skill in the art. As described further herein, dosages can be determined empirically using dosages known in the art for administration of bacteria.

The compositions, if desired, can be presented in a package, in a kit or dispenser device, that can contain one or more unit dosage forms containing the active ingredient. The pack or dispenser device can be accompanied by instructions for administration. The compositions containing the active agents can be packaged as articles of manufacture containing packaging material, an agent provided herein, and a label that indicates the disorder for which the agent is provided.

2. Combinations

Combinations can include two or more agents provided herein.

For example, a combination can include a microorganism or cell provided herein expressing an exogenous gene that encodes a detectable compound and a pharmaceutically acceptable carrier.

For example, a combination can include a microorganism or cell provided herein expressing an exogenous gene that is regulated by an inducible promoter, a molecule that induces the promoter (e.g., arabinose) and a pharmaceutically acceptable carrier.

For example, a combination can include a microorganism or cell provided herein over-expressing a gene that encodes a ferritin-like compound and a pharmaceutically acceptable carrier.

For example, a combination can include a microorganism or cell provided herein, a siderophore conjugated to a detectable label or a therapeutic agent and, optionally, a pharmaceutically acceptable carrier.

For example, a combination can include a microorganism or cell provided herein, a nanoparticle conjugated to a detectable label or a therapeutic agent and, optionally, a pharmaceutically acceptable carrier.

A detectable compound can include a ligand or substrate or other compound that can interact with and/or bind specifically to a microorganismally expressed protein or RNA molecule, and can provide a detectable signal, such as a signal detectable by any of the imaging techniques provided herein or otherwise known in the art. Exemplary detectable compounds can be, or can contain, an imaging agent such as a magnetic resonance, ultrasound or tomographic imaging agent, including a radionuclide. The detectable compound can include any of a variety of compounds as provided elsewhere herein or are otherwise known in the art. Typically, the detectable compound included with a microorganism or cell in the combinations provided herein will be a compound that is a substrate, a ligand, or can otherwise specifically interact with, a protein or RNA encoded by the microorganism; in some examples, the protein or RNA is an exogenous protein or RNA. Typically, the detectable compound included with a microorganism or cell in the combinations provided herein will be a ligand that interacts with the microorganism. In a non-limiting example, a siderophore conjugated to a detectable moiety will be administered to an individual concomitant with, or subsequent to, a bacteria having a receptor that recognizes and transports the siderophore. In another non-limiting example, an antibody conjugated to a detectable moiety will be administered to an individual concomitant with, or subsequent to, a bacteria having a receptor that that specifically binds the antibody. Any combination of elements provided herein can be combined to image a tumor.

Therapeutic compounds can include therapeutic compounds provided herein or known in the art to act in concert with a microorganism. Typically, the therapeutic compound included with a microorganism or cell in the combinations provided herein will be a compound that can act in concert with a microorganism, such as described elsewhere herein. In a non-limiting example, a siderophore conjugated to a therapeutic agent will be administered to an individual concomitant with, or subsequent to, a bacteria having a receptor that recognizes and transports the siderophore. In another non-limiting example, an antibody conjugated to a therapeutic agent will be administered to an individual concomitant with, or subsequent to, a bacteria having a receptor that that specifically binds the antibody. Any combination of elements provided herein can be combined to image a tumor.

3. Kits

Kits can include the pharmaceutical compositions and/or combinations provided herein, and one or more components such as instructions for use, one or more other microorganisms or cells, a device for detecting a microorganism or cell in a subject, a device for administering a compound to a subject, and a device for administering a compound to a subject.

Kits are packaged combinations that, optionally, include other reagents or devices, or instructions for use. Exemplary kits can include the microorganisms or cells provided herein and can, optionally, include one or more components such as instructions for use, a device for detecting a microorganism or cell in a subject and a device for administering a compound/composition to a subject.

In one example, a kit can contain instructions. Instructions typically include a tangible expression describing the microorganism or cell and, optionally, other components included in the kit, and methods for administration, including methods for determining the proper state of the subject, the proper dosage amount, and the proper administration method, for administering the microorganism. Instructions can also include guidance for monitoring the subject over the duration of the treatment time.

In another example, a kit can contain a device for detecting a microorganism or cell in a subject. Devices for detecting a microorganism or cell in a subject can include a low light or fluorescence imaging device for detecting light, for example emitted from luciferase or fluoresced from GFP, RFP, BFP, CFP, YFP, OFP, far-red fluorescent protein or near-infrared fluorescent protein, a magnetic resonance measuring device such as an MRI or NMR device, a tomographic scanner, such as a PET, CT, CAT, SPECT or other related scanner, an ultrasound device, or other device that can be used to detect a protein expressed by the microorganism or cell within the subject. Typically, the device of the kit will be able to detect one or more proteins expressed by the microorganism or cell of the kit. Any of a variety of kits containing microorganisms or cells and detection devices can be included in the kits provided herein, for example, a microorganism or cell expressing luciferase and a low light imager, or a microorganism or cell expressing green fluorescence protein and a low light imager or fluorescence imager.

Kits provided herein also can include a device for administering a microorganism or cell to a subject. Any of a variety of devices known in the art for administering compositions can be included in the kits provided herein. Exemplary devices include a hypodermic needle, an intravenous needle, a catheter, a needle-less injection device, an inhaler, and a liquid dispenser such as an eyedropper. Typically, the device for administering a microorganism or cell of the kit will be compatible with the microorganism or cell of the kit; for example, a needle-less injection device such as a high pressure injection device can be included in kits with microorganisms or cells not damaged by high pressure injection, but is typically not included in kits with microorganisms or cells damaged by high pressure injection.

Kits provided herein also can include a device for administering a compound/composition (e.g., siderophore, antibody, nanoparticle, peptide, protein, etc., as provided elsewhere herein) to a subject. Any of a variety of devices known in the art for administering medications to a subject can be included in the kits provided herein. Exemplary devices include a hypodermic needle, an intravenous needle, a catheter, a needle-less injection an inhaler, and a liquid dispenser. Typically the device for administering the compound of the kit will be compatible with the desired method of administration of the compound. For example, a compound to be delivered subcutaneously can be included in a kit with a hypodermic needle and syringe.

J. EXAMPLES

The following examples are included for illustrative purposes only and are not intended to limit the scope of the embodiments provided herein.

Example 1

Construction of Expression Clones and Control Plasmids for Bacterial Expression

A ColE1-derived vector pDESTR4-R3 (Invitrogen, SEQ ID NO: 57) was used to construct plasmids for the bacterial expression of ferritin, bacterioferritin, OmpA fusion proteins (OmpA/Spep ligand or OmpA/streptavidin ligand binding peptides), and/or GFP or LuxABCDE control proteins. pDESTR4-R3 is based on a ColE1 replicon (GenBank Accession No. NC_001371; SEQ ID NO: 1) containing an ampicillin resistance gene. The Multisite Gateway system (Invitrogen) was used to create expression plasmids in pDESTR4-R3. The resulting plasmids contain a 5' promoter sequence, a first DNA sequence encoding a selected protein, followed by an optional internal ribosome binding site and a second DNA sequence encoding a selected protein and/or 3' terminator sequence.

Promoters used in plasmid construction were the $E.$ $coli$ araBAD promoter ($P_{BAD}$; Ogden et al., Proc. Natl. Acad. Sci. USA. 77(6): 3346-50 (1980); nucleotides 1-54 of GenBank Accession No. K00953; SEQ ID NO: 2) to give tight, arabinose dose-dependent regulation of expression and the Bacillus subtilis rpsJ ($P_{S10}$; GenBank Accession No. U43929; SEQ ID NO: 3), the Bacillus megaterium xylA promoter (base pairs 1790-1818 of Genbank Accession No. Z71474; SEQ ID NO: 15) to give high-level constitutive expression, or the $E.$ $coli$ ompA promoter ($P_{ompA}$; GenBank Accession No. AF22312; SEQ ID NO: 4) to give constitutive expression.

A. Streptavidin Binding Ligand Peptides

SA-B1/OmpA and SA-B3$_{a/b}$/OmpA constructs were prepared using recombinant PCR techniques resulting in the insertion of a nucleotide sequence encoding the streptavidin binding ligand peptides and a SfiI site into the open reading frame of $E.$ $coli$ OmpA. The amino acid sequences of the streptavidin binding ligand peptides (SA-B1 SEQ ID NO: 49; SA-B3a: SEQ ID NO: 50; SA-B3b: SEQ ID NO: 51) are underlined in the three sequences below.

```
Amino acid sequence of SA-B1/ompA:
                                     (SEQ ID NO: 5)
MKKTAIAIAVALAGFATVAQAAPKDNTWYTGAKLGWSQYHDTGLIGQRLE

ICQNVCYYLGTLNGPTHENQLGAGAFGGYQVNPYVGFEMGYDWLGRMPYK

GSVENGAYKAQGVQLTAKLGYPITDDLDIYTRLGGMVWRADTKSNVYGKN

HDTGVSPVFAGGVEYAITPEIATRLEYQWTNNIGDAHTIGTRPDNGMLSL

GVSYRFGQGEAAPVVAPAPAPAPEVQTKHFTLKSDVLFNFNKATLKPEGQ

AALDQLYSQLSNLDPKDGSVVVLGYTDRIGSDAYNQGLSERRAQSVVDYL

ISKGIPADKISARGMGESNPVTGNTCDNVKQRAALIDCLAPDRRVEIEVK

GIKDVVTQPQA.
```

```
                          -continued
Amino acid sequence of SA-B3a/ompA:
                                              (SEQ ID NO: 6)
MKKTAIAIAVALAGFATVAQAAPKDNTWYTGAKLGWSQYHDTGLIGQTVL

ICMNICWTGETQNGPTHENQLGAGAFGGYQVNPYVGFEMGYDWLGRMPYK

GSVENGAYKAQGVQLTAKLGYPITDDLDIYTRLGGMVWRADTKSNVYGKN

HDTGVSPVFAGGVEYAITPEIATRLEYQWTNNIGDAHTIGTRPDNGMLSL

GVSYRFGQGEAAPVVAPAIPAPAPEVQTKHFTLKSDVLFNFNKATLKPEG

QAALDQLYSQLSNLDPKDGSVVVLGYTDRIGSDAYNQGLSERRAQSVVDY

LISKGIPADKISARGMGESNPVTGNTCDNVKQRAALIDCLAPDRRVEIEV

KGIKDVVTQPQA.

Amino acid sequence of SA-B3b/ompA:
                                              (SEQ ID NO: 7)
MKKTAIAIAVALAGFATVAQAAPKDNTWYTGAKLGWSQYHDTGLIGQGVL

ICMNICWTGETQNGPTHENQLGAGAFGGYQVNPYVGFEMGYDWLGRMPYK

GSVENGAYKAQGVQLTAKLGYPITDDLDIYTRLGGMVWRADTKSNVYGKN

HDTGVSPVFAGGVEYAITPEIATRLEYQWTNNIGDAHTIGTRPDNGMLSL

GVSYRFGQGEAAPVVAPAPAPAPEVQTKHFTLKSDVLFNFNKATLKPEGQ

AALDQLYSQLSNLDPKDGSVVVLGYTDRIGSDAYNQGLSERRAQSVVDYL

ISKGIPADKISARGMGESNPVTGNTCDNVKQRAALIDCLAPDRRVEIEVK

GIKDVVTQPQA.
```

Primer sequences for SA-B1 and SA-B3 were generated and codon usage in those primers was optimized for expression in *E. coli*. Nucleotide sequences for the plasmids carrying the recombinant proteins are set forth in SEQ ID NOS: 34-39.

B. S-Peptide Ligand

SPep/OmpA constructs were prepared using recombinant PCR techniques resulting in the insertion of a nucleotide sequence encoding the S-peptide (SPep) ligand peptides and a SfiI site into the open reading frame of *E. coli* OmpA similar to the SA-B peptides. The SPep amino acid sequence (KETAAAKFERQHMDS; SEQ ID NO: 43) corresponds to amino acids residues 1-15 of the mature bovine RNAseA protein. This peptide binds the C-terminal (aa21-124) of RNAseA (the S-Protein) with high affinity. Primer sequences for SPep were generated and codon usage in those primers was optimized for expression in *E. coli*. Nucleotide sequences for the plasmids carrying the recombinant proteins are set forth in SEQ ID NOS: 40-42. The human SPep amino acid sequence (KESRAKKFQRQHMDS; SEQ ID NO: 48) that binds to aa21-125 of human RNAseA, can also be used to make SPep/OmpA.

C. Ferritin, Bacterioferritin, and Dodecameric Ferritin

Coding regions for *E. coli* Ferritin (ftn/rsgA, Genbank Accession No. X53513; SEQ ID NO: 8) and *E. coli* bacterioferritin (bfr; Genbank Accession No. L28106; SEQ ID NO: 9) genes were amplified using PCR from *E. coli* Top10 cells (Invitrogen). The PCR product was designed to incorporate a strong ribosome binding site (RBS) at the 5' end of the coding sequences. The RBS incorporates specific bases within the coding region of the protein where using the bases does not change the polypeptide, and so are native to the sequence or constitute silent mutations. The RBS is incorporated into primer design, where using the bases would not alter the native polypeptide. Thus, no changes were made to the amino acid sequence of the ferritin or bacterioferritin polypeptides (SEQ ID NOS: 52 and 53). For dodecameric ferritin (dps), a dps homolog was PCR amplified from *Listeria monocytogenes* (SEQ ID NO: 60).

D. Control and Terminator Sequences

For constructs containing GFP and luxABCDE genes, DNA sequences encoding the GFP and LuxABCDE proteins (SEQ ID NOS: 54 and 55) were amplified by PCR from plasmid pSB2030 (Qazi, SNA, Counil E, Morrissey J, Rees CED, Cockayne A, Winzer K, Chan W C, Williams P, Hill P J. (2001) "agr expression precedes escape from the endosome of *Staphylococcus aureus*." *Infection and Immunity*: 69(11): 7074-7082; SEQ ID NO: 56). For constructs containing the transcriptional terminators T1 and T2 of the *E. coli* rrnB gene (SEQ ID NO: 10), DNA sequences for T1 and T2 were obtained by PCR from *E. coli* Top10 cells (Invitrogen).

The translation initiation region including the RBS that was used for the construction of the expression cassettes provided herein is based on alignments as described in Vellanoweth R L. *Translation and its regulation*. In: Sonenshein A L, Hoch J A, Losick R (eds.) *Bacillus subtilis* and Other Gram Positive Bacteria; Biochemistry, Physiology and Molecular Genetics. American Society for Microbiology, Washington, D.C., pp 699-711 (1993). The ideal translational initiation region includes the RBS and adjacent bases up to and including the start codon. An exemplary consensus sequence for a translational initiation region is 5'-TTAnnAAGGAGGAATAAAAA ATGnTAAAAAACAAATnnnnnnC-3' (where "n" represents A, T, G or C and underlined sequence indicates the coding sequence; SEQ ID NO: 11). The consensus sequence of 5'-AAGGAGGAATAAAAA ATG-3' contained in the exemplary translational initiation region above was used before the coding sequence (CDS) in the constructs provided herein.

The expression cassettes were prepared as transcriptional fusion proteins such that, for example, for $P_{BAD}$::ftn::GFP expression cassettes, ferritin and GFP are made as separate proteins from the same mRNA. The Multisite Gateway system (Invitrogen) was employed to assemble the expression cassettes using recombination techniques outlined in the manufacturer's instructions. The expression cassettes and associated plasmid sequences are provided in Table 7 and the Sequence Listing. All clones were propagated in *E. coli* Top 10 bacteria. Plasmid construction was confirmed by phenotype, restriction mapping and DNA sequencing.

An additional plasmid containing GFP and luxABCDE genes was constructed using the Multisite Gateway system (Invitrogen) and a derivative of the pDESTR4-R3 plasmid, pBR322DEST. For construction of pBR322DEST, the ccdB gene for negative selection, the chloramphenicol resistance gene cmR for counterselection and the attR3 and attR4 recombination sites were PCR amplified from pDESTR4-R3, inserted into the ClaI restriction site in the plasmid pBR322, and transformed into *E. coli* ccdB Survival T1R (InVitrogen). Orientation of the insert was confirmed by PstI digest and agarose gel electrophoresis. pBR322DEST-$P_{BAD}$::GFP::luxABCDE::rrnB$_{T1T2}$ (also called pBR322DEST-$P_{BAD}$DUAL-term; SEQ ID NO: 81) was obtained after LR-recombination was performed as described in the Multisite Gateway® three vector construction kit protocol of the manufacturer (Invitrogen, Carlsbad, USA).

TABLE 7 pDESTR4-R3 Plasmid constructs

| Promoter | Construct | SEQ ID NO: |
|---|---|---|
| $P_{BAD}$ | $P_{BAD}$::ftn::GFP | 16 |
|  | $P_{BAD}$::bfr::GFP | 17 |
|  | $P_{BAD}$::bfr::ftn | 18 |
|  | $P_{BAD}$::GFP::rrnB$_{T1T2}$ | 19 |
|  | $P_{BAD}$::GFP::luxABCDE::rrnB$_{T1T2}$ | 20 |
|  | $P_{BAD}$::luxABCDE::rrnB$_{T1T2}$ | 21 |
|  | $P_{BAD}$::dps::GFP | 58 |
| $P_{S10}$ | $P_{S10}$::bfr::GFP | 22 |
|  | $P_{S10}$::ftn::GFP | 23 |
|  | $P_{S10}$::bfr::ftn | 24 |
|  | $P_{S10}$::GFP::rrnB$_{T1T2}$ | 25 |
|  | $P_{S10}$::GFP::luxABCDE::rrnB$_{T1T2}$ | 26 |
|  | $P_{S10}$::luxABCDE::rrnB$_{T1T2}$ | 27 |
| $P_{xylA}$ | $P_{xylA}$::bfr::GFP | 28 |
|  | $P_{xylA}$::ftn::GFP | 29 |
|  | $P_{xylA}$::bfr::ftn | 30 |
|  | $P_{xylA}$::GFP::rrnB$_{T1T2}$ | 31 |
|  | $P_{xylA}$::GFP::luxABCDE::rrnB$_{T1T2}$ | 32 |
|  | $P_{xylA}$::luxABCDE::rrnB$_{T1T2}$ | 33 |
|  | $P_{xylA}$::dps::GFP | 59 |
| $P_{ompA}$, $P_{xylA}$ and $P_{BAD}$ | $P_{ompA}$::SA-B1/ompA::rrnB$_{T1T2}$ | 34 |
|  | $P_{ompA}$::SA-B3/ompA | 35 |
|  | $P_{ompA}$::SA-B3/ompA::ftn | 36 |
|  | $P_{ompA}$::SA-B3/ompA::GFP | 37 |
|  | $P_{xylA}$::SA-B3/ompA::GFP | 38 |
|  | $P_{BAD}$::SA-B3/ompA::ftn | 39 |
| $P_{BAD}$, $P_{xylA}$ and $P_{ompA}$ | $P_{BAD}$::SPep/ompA::GFP | 40 |
|  | $P_{xylA}$::SPep/ompA::GFP | 41 |
|  | $P_{ompA}$::Spep/ompA::ftn | 42 |
| $P_{BAD}$ | $P_{BAD}$::GFP::luxABCDE::rrnB$_{T1T2}$ (in pBR322DEST) | 81 |

Example 2

In Vitro Evaluation of $P_{BAD}$::Ferritin and $P_{BAD}$::Bacterioferritin Clones A. Siderophore Assay Plates Expression of ferritin and homologs by E. coli transformed with ferritin-encoding DNA under the control of an arabinose-inducible promoter was evaluated by an indirect assay for free iron. Ferritin over-expression is accompanied by a decrease in free intracellular iron concentration, which results in up-regulation of iron-repressible protein expression, due in part to de-repression of the Fur regulon. Thus, this siderophore assay for iron-repressible protein expression can be used as an indirect measure of free intracellular iron which in turn reflects ferritin expression. Examples of iron-repressible proteins in E. coli include siderophores that are synthesized to capture iron from the host for use by the bacteria. E. coli Nissle 1917 (Oelschlaeger lab, Würzburg, Germany, Ardeypharm GmbH (Herdecke, Germany)) was employed for expression of the ferritin and/or bacterioferritin plasmids. In order to decrease incompatibility of transfected plasmids, a derivative of Nissle 1917, cured of its two plasmids (pMUT1 and pMUT2) was used. (Method described in Altenhoefer et al. FEMS Immunology and Medical Microbiology 20:223-229 (2004). Briefly, Nissle 1917 was transformed with a pMUT1 plasmid carrying the tetA and sacB genes and a pMUT2 plasmid carrying the kan and sacB genes, selected on tetracycline and kanamycin plates, then subsequently selected on sucrose plates to select for loss of the plasmids). Gel analysis of plasmid preps confirmed the absence of the plasmids.

Siderophore expression can be evaluated in vitro as follows: overnight cultures of E. coli Nissle 1917 (transformed with plasmids $P_{BAD}$::ftn::GFP, $P_{BAD}$::bfr::GFP, $P_{BAD}$::bfr::ftn, $P_{BAD}$::GFP::rrnB$_{T1T2}$ using standard bacterial electroporation protocols as provided in Sambrook, J., E. F. Fritsch, and T. Maniatis. 1989. Molecular cloning: a laboratory manual, 2nd ed. Cold Spring Harbor Laboratory Press, Cold Spring Harbor, N.Y.) were grown in BHI broth at 37° C. and 200 rpm; 20 μl aliquots of these cell suspensions were pipetted into separate wells bored into Chrome Azurol S (CAS) agar plates containing ampicillin (100 mg/l) with 0.2% arabinose (Schwyn, B., and Neilands, B J. Anal. Biochem. 160: 47-56 (1987)). The transformed plasmids remain as autonomously replicating plasmids in E. coli Nissle and express the indicated genes; ftn, bfr, ftn and bfr, or GFP. Up-regulation of iron-repressible proteins by the bacteria is indicated by larger yellow halos around colonies indicative of up-regulated siderophore production. A GFP expression plasmid is used as a negative control.

Mean halo diameters measured after overnight incubation of the plates at 37° C. were as described in Table 8.

TABLE 8

| Plasmid | Mean halo diameter |
|---|---|
| $P_{BAD}$::ftn::GFP | 17 mm |
| $P_{BAD}$::bfr::GFP | 13 mm |
| $P_{BAD}$::bfr:ftn | 17 mm |
| $P_{BAD}$::GFP::rrnBT1T2 | 12.6 mm |

E. coli Nissle 1917 strains that had been transformed with DNA encoding a ferritin and GFP proteins or a bacterioferritin and ferritin proteins driven by an arabinose-inducible promoter were maintained in the presence of 0.2% arabinose and exhibited a strong increase in iron-repressible protein expression (as indicated by the increased yellow halo around the colonies) compared to that around E. coli Nissle 1917 strains that had been transformed with DNA encoding GFP alone or encoding bacterioferritin and GFP proteins driven by an arabinose-inducible promoter. Thus, the increases in siderophore production observed were due to the presence of ferritin and/or bacterioferritin. PAGE analysis confirmed GFP, ferritin or bacterioferritin gene up-regulation in the presence of arabinose compared to control samples.

B. Colorimetric Iron Assay

Expression of ferritin, bacterioferritin or a combination thereof by E. coli transformed with DNA under the control of an arabinose-inducible promoter was evaluated using a direct assay for iron accumulation in the bacterial cells. Thus, this assay for iron accumulation can be used as a direct measure of intracellular iron which in turn reflects ferritin and/or bacterioferritin expression.

To test ferritin (ftn) and bacterioferritin (bfr) expression and iron sequestration, cultures of E. coli Nissle 1917 containing plasmids $P_{xylA}$::bfr::GFP (XBG; SEQ ID NO: 28), $P_{xylA}$::ftn::GFP (XFG; SEQ ID NO: 29), $P_{xylA}$::dps::GFP (XDG; SEQ ID NO: 59), $P_{xylA}$::bfr::ftn (XBF; SEQ ID NO: 30), $P_{xylA}$::GFP::rrnB$_{T1T2}$ (XGT; SEQ ID NO: 31), $P_{BAD}$::ftn::GFP (AFG; SEQ ID NO: 16), $P_{BAD}$::bfr::GFP (ABG; SEQ ID NO: 17), $P_{BAD}$::dps::GFP (ADG; SEQ ID NO: 58), $P_{BAD}$::bfr:ftn (ABF; SEQ ID NO: 18), and $P_{BAD}$::GFP::rrnB$_{T1T2}$ (AGT; SEQ ID NO: 19), were grown overnight with shaking at 200 rpm at 37° C. in iron-rich BHI/ampicillin (150 μM FeCl$_3$) supplemented with 0 or 0.2% arabinose. Bacterial cells were harvested by centrifugation and washed twice with PBS and concentrated 10× in PBS. 200 μl of concentrated cells were subjected to lysis using BugBuster with benzonase (Novagen). 10 µl Aliquots of lysate were removed for total protein estimation by Bradford assay (Biorad kit). 50 µl aliquots of the remaining lysates were subjected to an iron assay using BioAssay Systems' Quantichrom Iron assay kit (DIFE 250), which measures total iron ($Fe^{2+}$ and $Fe^{3+}$) in the samples. The protease treatment of the samples allows for release of iron from ferritin cages. A GFP expression plasmid was used as a negative control. A standard curve of iron at 0, 0.3125, 0.625, 1.25, 2.5, 5 and 10 mg/L was used.

Those cells over-expressing bacterioferritin and GFP, bacterioferritin and ferritin, or Dps and GFP from the strong xylA promoter (XBG, XBF, XDG) showed a significant increase in iron accumulation as compared to those constructs expressing GFP alone from $P_{xylA}$ (XGT respectively). Similarly induction of cells expressing ferritin, bacterioferritin or dps from $P_{BAD}$ with 0.2% arabinose (ABG, ADG, ABF, AFG induced), showed significant increase in iron accumulation as compared to similar constructs expressing GFP alone.

Un-induced cultures of all the $P_{BAD}$ expression vectors (ABG, AFG, ABF, AGT) showed lower levels of iron accumulation than the respective strains induced with 0.2% arabinose. Results are shown in Table 9. Taken together, these experiments show that overexpression of ferritin and/or bacterioferritin in *E. coli* Nissle can increase the overall uptake of iron by the bacteria.

TABLE 9

| Strain | Arabinose | (mg iron/l culture) | Genes Expressed |
|---|---|---|---|
| XBG | 0% | 42.2 | bfr, GFP |
| XDG | 0% | 37.8 | dps, GFP |
| XFG | 0% | 12.5 | ftn, GFP |
| XBF | 0% | 45.0 | bfr, ftn |
| XGT | 0% | 11.7 | GFP |
| ABG | 0% | 25.0 | bfr, GFP |
| ADG | 0% | 8.9 | dps, GFP |
| AFG | 0% | 6.8 | ftn, GFP |
| ABF | 0% | 31.2 | bfr, ftn |
| AGT | 0% | 4.1 | GFP |
| ABG | 0.20% | 48.9 | bfr, GFP |
| ADG | 0.20% | 34.7 | dps, GFP |
| AFG | 0.20% | 26.1 | ftn, GFP |
| ABF | 0.20% | 39.1 | bfr, ftn |
| AGT | 0.20% | 11.3 | GFP |

C. In Vitro MRI of pBAD Ferritin Clones

MRI data were generated from *E. coli* Nissle with un-induced (ABG, ADG, AFG, ABF, AGT) and induced with 0.2% arabinose (ABGA, ADGA, AFGA, ABFA, AGTA) ferritin, bacterioferritin, dps and GFP control expression cassettes. Bacteria were grown in 50 ml BHI broth containing 150 µM $FeCl_3$ at 37° C. with shaking at 200 rpm overnight. Samples were then washed 3× in equal volumes of PBS then the bacteria were pelleted, resuspended in 2.5 ml PBS containing 4% formaldehyde and 0.2 ml were transferred into a 0.2 ml PCR tube. Tubes were imaged simultaneously in a GE 7T small animal MRI. The 7T (21 cm bore) animal imaging system includes a Magnex magnet equipped with GE hardware, including: Signa EXCITE III core system electronics and operating environment, including 16 digital receivers and 2 digital transmitters capable of programmable decoupling; Resonance Research BFG-200/120-440-S shielded gradient coil assembly, including 2nd and 3rd order resistive shim coils; Copley 266 high stability switching gradient amplifiers with GP2c digital control interface; Resonance Research 14 channel +/−5 Amp per channel high stability computer controlled shim driver; Volume $^1H$ transmit coil with active detuning, switchable between transmit/receive and transmit only, with an inner diameter of 10 cm; 8 channel insertable $^1H$ receive array coil for imaging mice, with a cylindrical geometry open at both ends, and an ID of 3 cm; 15 mm transmit/receive surface coils and appropriate T/R switches for $^1H$, $^{31}P$, $^{23}Na$, and $^{13}C$; Dual tuned surface coils for $^1H/^{31}P$ and $^1H/^{13}C$; Small animal support cradle with laser positioning system; and Cardiac and respiratory gating modules.

Tubes were imaged simultaneously, Images were acquired with spin echo sequence, TE/TR 50/3000. Counts measured in a single plane across the tubes. The relative counts from the bacterial pellets are provided in Table 10.

TABLE 10

| Strain | Arabinose concentration | Relative counts |
|---|---|---|
| — (water) | 0% | 2418 |
| AGT | 0% | 497 |
| ABF | 0% | 250 |
| AFG | 0% | 478 |
| ADG | 0% | 603 |
| ABG | 0% | 270 |
| AGTA | 0.20% | 527 |
| ABFA | 0.20% | 219 |
| AFGA | 0.20% | 308 |
| ADGA | 0.20% | 442 |
| ABGA | 0.20% | 187 |

The ratio of uninduced to induced cultures is as follows: ABG=1.44, ADG=1.36, AFG=1.55, ABF=1.14, AGT=0.94. *E. coli* Nissle 1917 without expression of additional iron storage genes also affects the MRI signal. This is probably due to the natural iron storage capability of *E. coli* Nissle 1917. In addition the MRI signal is affected by proteins and lipids that are present in *E. coli* Nissle 1917. In conclusion, these experiments demonstrate that overexpression of ferritin and/or bacterioferritin in *E. coli* Nissle can increase the MRI contrast via increased uptake of iron, which enhances its ability to be used as an imaging agent.

D. Comparison of In Vitro Iron Uptake of pBAD Ferritin Clones with In Vitro MRI at Different Spin Echo Sequences In a separate experiment, cultures of ferritin-expressing bacteria were evaluated for iron uptake by both the iron uptake assay and MRI imaging. Cultures of bacteria containing the $P_{xylA}$ promoter for expression of the heterologous genes were used in the comparison. Resuspended bacterial overnight cultures (grown in BHI supplemented with iron) were washed twice in PBS and then resuspended in PBS+ OCT (1:1) and aliquoted into wells of a 5% agarose gel. The cultures were concentrated about 25-fold for imaging. Different spin echo sequences were performed with a constant repetition time TR of 4000 ms. Imaging was done for each echo time TE (10, 20, 40, 80, 120, and 160 ms), and the $1/T_2$ calculated for each well. Samples from the same cultures were used measured the iron uptake into the bacteria. Expression of bacterioferritin and dodecaferritin under control of the $P_{xylA}$ promoter exhibited similar amounts of iron uptake in the iron uptake assay, though bacterioferritin produced a better signal for MRI imaging.

| Strain | $1/T_2$ ($s^{-1}$) | Iron (mg/L) |
|---|---|---|
| EcN | 10.4 | 374.5 |
| -XBG | 45.5 | 1342.1 |
| -XDG | 16.5 | 1342.1 |

-continued

| Strain | 1/T$_2$ (s$^{-1}$) | Iron (mg/L) |
|---|---|---|
| -XFG | 17.2 | 895.8 |
| -XGT | 3.7 | 140.9 |
| EcN/2 (+) -XBG/2 | 24.1 | 858.3 |
| EcN3/4 (+) -XBG/4 | 16.5 | 616.4 |

EcN: *E. coli* Nissle 1917;
-XBG: EcN PxylA-bfr-GFP;
-XDG: EcN PxylA-dps-GFP;
-XGT: EcN PxylA-GFP-term;
-XFG: EcN PxylA-dps-GFP;
-XGT EcN PxylA-GFP-term;
EcN/2 (+) -XBG/2: EcN (50%) mixed with EcN PxylA-bfr-GFP (50%);
EcN3/4 (+) -XBG/4: EcN (75%) mixed with EcN PxylA-bfr-GFP (25%).

E. In Vivo MRI of pBAD Ferritin Clones

In vivo MR imaging was performed using *E. coli* Nissle 1917 containing plasmid pDESTR4-R3P$_{BAD}$-bfr-GFP (SEQ ID NO: 17). Tumors were established in BALB/c mice by implantation of 3.3×10$^4$ 4T1 tumor cells into the mice 15 days prior to injection of the bacteria. *E. coli* Nissle was grown in LB broth containing 100 μg/ml ampicillin to an OD600 nm of 0.4, washed twice with PBS, diluted, and then injected (5×10$^5$ cells) into the tail vein of 4T1 tumor bearing BALB/c mice. Four days after bacterial injection mice were imaged on a GE small animal MRI scanner (7T). Animals were imaged prior to L-arabinose injection and 1, and 2 h post L-arabinose tail vein injection (200 μl of 25% L-arabinose solution). The injection of arabinose resulted in a signal decrease (positive MRI signal) around the necrotic region of the tumor where the bacteria colonize. In control tumor bearing mice which were not injected with bacteria or infected with the wild type *E. coli* Nissle, there was no signal decrease.

Example 3

Binding of Enzymes to Bacterial Surfaces Via Surface Ligand Expression

*E. coli* can be transformed with DNA encoding recombinant proteins, such as outer membrane proteins (i.e. OmpA) bearing surface peptides that bind cognate ligands. The recombinant proteins are synthesized as fusion proteins in which the surface polypeptide is fused to an extracellular portion of the outer membrane protein to allow for expression of the polypeptide on the surface of the bacterium. The ligands can be labeled with a diagnostic or therapeutic moiety. Thus, the recombinant protein can be used as a tool to visualize bacterial localization in a subject, such as bacteria localized to tumors, wounds, areas of inflammation and infections, to treat tumor cells, wounds, inflammation and infections by targeting a therapeutic agent to bacteria localized in such areas, or a combination thereof.

A. Streptavidin Ligand Peptide (SA-B)

*E. coli* Top10 was transformed with the plasmids P$_{ompA}$::SA-B1/ompA::rrnB$_{T1T2}$ (SEQ ID NO: 34), P$_{ompA}$::SA-B31ompA (SEQ ID NO: 35), P$_{ompA}$::SA-B3/ompA: ftn (SEQ ID NO: 36), P$_{ompA}$::SA-B3/ompA::GFP (SEQ ID NO: 37), P$_{xylA}$::SA-B3/ompA::GFP (SEQ ID NO: 38), or P$_{BAD}$::SA-3/ompA::ftnI (SEQ ID NO: 39), to test expression of the streptavidin ligand peptides on the surface of the bacteria. An overnight culture of *E. coli* Top 10 bacteria expressing the streptavidin ligand peptide/OmpA fusion proteins, or OmpA alone (control), was grown in 2×YT broth containing 100 μg/ml ampicillin and was diluted 1:50 into fresh medium and grown to the logarithmic phase (OD600: 0.6 nm). 100 μl of the culture was harvested by centrifugation, washed in PBS and resuspended in an equal amount of PBS containing streptavidin-conjugated horseradish peroxidase (HRP; 1:1000; obtained from Sigma). After incubating for 30 min at room temperature, the bacteria were centrifuged and washed 2 times in PBS. They were resuspended in 100 μl PBS and 1 μl was used for an HRP-assay using either 4-Chloronaphtol/H$_2$O$_2$ or enhanced chemiluminescence (ECL).

Bacteria expressing the streptavidin (SA) ligand peptide exhibited the peptide on their surface and the peptides (ligands) were detected. The bacteria expressing ligands on their surface can bind proteins which, in turn, can be conjugated to enzymes (like HRP), other proteins or, for example, (nano-)particles, for imaging purposes.

B. S-Peptide Ligand

*E. coli* Top10 was transformed with the plasmids P$_{BAD}$::SPep/ompA::GFP (SEQ ID NO: 40), P$_{xylA}$::SPep/ompA::GFP (SEQ ID NO: 41) and P$_{ompA}$::Spep/ompA::ftn (SEQ ID NO: 42) to test expression of the S-peptides on the surface of the bacteria. *E. Coli* Top 10 transformed with SA-B plasmids (section A, above) were used for negative controls. Resulting strains were cultured overnight in LB medium containing 100 μg/ml ampicillin at 37° C. *E. coli* Top10 P$_{BAD}$-SPep-ompA-gfp was additionally incubated with 0 or 0.2% arabinose to induce the P$_{BAD}$ promoter. 0.5 ml of the overnight culture were harvested by centrifugation, and incubated with 1:250 diluted S-Protein conjugated HRP (Novagen) for 30 min at room temperature in PBS. After washing twice in PBS, the bacteria were resuspended in 100 μl PBS and 5 μl of the suspension was used in a chemoluminescence test (ECL) for HRP. The resulting light emission was captured with an Argus 100 low light imager (Hamamatsu Photonics, Hamamatsu, Japan).

Bacteria expressing the S-peptide ligand exhibited the peptide on their surface and the peptides (ligands) were detected. The S-peptide ligand can thus be expressed on the surface of *E. coli* as an OmpA fusion protein and can specifically bind to the S-Protein with high affinity. Therefore, the S-Peptide/S-Protein pair is an alternative to the SA-3/streptavidin pair and is useful for in vivo methods since no endogenous proteins (ligands) are known to inhibit the interaction.

Example 4

Binding of Magnetic-Nanoparticles

Enrichment of Ligand-Expressing Bacteria

Bacteria that express ligands to bind iron nanoparticles on their cell surface can be enriched from mixed cultures using magnetic separation techniques.

An overnight culture of two different strains of *E. coli* Top10 (*E. Coli* Top10 P$_{xylA}$::luxABCDE::rrnB$_{T1T2}$, SEQ ID NO: 33; and *E. coli* Top10 P$_{xylA}$::SA-B3/ompA::GFP, SEQ ID NO: 38), grown in 2×YT broth containing 100 μg/ml ampicillin, were diluted 1:5 into fresh medium, grown for 90 min and grown for another 90 min after addition of arabinose (end concentration: 0.02%). The control strain expressed the lux operon but wild-type OmpA, while the test strain expressed SA-B3/OmpA and no lux genes. 500 μl of each culture were mixed, centrifuged, washed in PBS and resuspended in 350 μl of phosphate buffered saline (PBS). Ten μl Streptavidin-coated iron-nanoparticles (Miltenyi Biotech Inc., order nr. 130-048-101) were added and after 15 min 250 μL of the mix was loaded on PBS-equilibrated μMACS columns (Miltenyi Biotech Inc.) while a magnetic field was applied (μMACS system). The remaining 100 μl of the mixture were used to determine the proportion of each strain in the mixture by plating serial dilutions on selective agar plates and counting lux-expressing and non-expressing colony forming units (CFU). Then, the columns were washed twice with 250 µl PBS and finally eluted with the same volume of PBS. The proportion of each strain was again measured by plating serial dilutions of selective agar plates, and the next day, lux expressing/non-expressing CFU were counted to obtain the proportion of SA-B3-expressing bacteria.

Prior to application of the magnet, approximately 53% of the bacteria in the mixed culture were OmpA+LUX+ and 47% were OmpA+/SA-B3+. Following application of the magnet, approximately 92% of the bacteria were found to express SA-B3 and only 7% of those bacteria were lost on the columns and while washing respectively. Thus, SA-B3-expressing bacteria were enriched using the disclosed methods.

Example 5

Selection of Bacterial Species Based on Tumor Colonization Experiments

The tumor-colonizing capability of a variety of bacteria can be directly measured by injecting bacteria into appropriate tumor-bearing animal models and the tumors assessed for colonization. Additionally, specificity of the bacteria to localize to the tumors compared to non-tumorous tissues can be measured.

4T1 tumor cells ($3.3 \times 10^4$ in 100 µl PBS; Christensen et al., Cancer Res. 58(6):1238-44 (1998)) were injected into the hind leg of 5-7 week old female nude mice (Harlan) 14 days (d) prior to bacterial injection. Various species of bacteria, including B. subtilis, V. cholerae CVD 103-HgR (ATCC 55456), E. coli (natural isolate), E. coli DH5α (Invitrogen), S. flexneri SC602 (Barzu, et al. Infect. Immun. 64: 1190-1196 (1996)), EIEC 4608-58 (Hale et al. Infect Immun. 40(1): 340-350 (1983)) and E. coli Nissle 1917 strain were injected intravenously (i.v.) into the mice. Bacterial load was measured 5 days post-injection. Tumors, spleens and livers were surgically removed and analyzed for bacterial load (colony forming units (CFU)/g). The organs were sliced into pieces, homogenized in a MagnaLyser (Roche) in tubes with ceramic beads (Roche) containing 0.5 ml sterile water in portions of about 0.5 g for 2×30 s. Serial dilutions of the homogenized suspensions were made and plated on LB agar plates. Results are provided in Tables 11a, 11b and 11c.

TABLE 11a

| Bacteria | Amount Injected | Tumor (CFU/g) | Spleen (CFU/g) | Liver (CFU/g) |
| --- | --- | --- | --- | --- |
| B. subtilis | $2 \times 10^6$ | $9.1 \times 10^4 \pm 1.3 \times 10^5$ | $95 \pm 57$ | $87 \pm 65$ |
| V. cholerae CVD-103 HgR | $3 \times 10^7$ | $7.0 \times 10^6 \pm 5.5 \times 10^6$ | $19 \pm 37$ | $34 \pm 22$ |
| E. coli | $5.5 \times 10^7$ | $6.3 \times 10^8 \pm 4.3 \times 10^8$ | $2.1 \times 10^3 \pm 2.4 \times 10^3$ | $1.2 \times 10^4 \pm 2.0 \times 10^4$ |
| E. coli DH5a | $5 \times 10^7$ | $2.9 \times 10^9 \pm 1.4 \times 10^9$ | $1.1 \times 10^3 \pm 1.6 \times 10^3$ | $5.1 \times 10^3 \pm 3.4 \times 10^3$ |
| S. flexneri SC602 | $5 \times 10^7$ | $2.8 \times 10^9 \pm 2.1 \times 10^9$ | $9.0 \times 10^3 \pm 1.8 \times 10^4$ | $1.2 \times 10^3 \pm 2.2 \times 10^3$ |
| EIEC 4608-58 | $1 \times 10^8$ | $1.3 \times 10^{10} \pm 1.7 \times 10^{10}$ | $1.3 \times 10^4 \pm 8.4 \times 10^3$ | $1.2 \times 10^5 \pm 1.3 \times 10^5$ |
| E. coli Nissle 1917 | $1 \times 10^7$ | $5.0 \times 10^8 \pm 4.6 \times 10^8$ | $0 \pm 0$ | $1.8 \times 10^3 \pm 3.6 \times 10^3$ |

TABLE 11b ($3.3 \times 10^4$ 4T1 tumor cells implanted)

| Bacteria | Amount Injected | Tumor (CFU/g) | Spleen (CFU/g) | Liver (CFU/g) |
| --- | --- | --- | --- | --- |
| E. coli Top 10 | $1 \times 10^7$ | $1.4 \times 10^8 \pm 1.8 \times 10^8$ | $0 \pm 0$ | $46 \pm 93$ |
| E. coli Nissle 1917 | $5.4 \times 10^6$ | $2.3 \times 10^8 \pm 1.7 \times 10^8$ | $7.9 \times 10^3 \pm 3.5 \times 10^3$ | $1.4 \times 10^5 \pm 2.6 \times 10^5$ |
| E. coli CFT073 UPEC | $4.3 \times 10^6$ | $7.1 \times 10^8 \pm 2.2 \times 10^8$ | $3.8 \times 10^3 \pm 6.8 \times 10^3$ | $587 \pm 783$ |
| E. coli EIEC | $4.5 \times 10^6$ | $3.4 \times 10^8 \pm 2.3 \times 10^8$ | $307 \pm 248$ | $4.5 \times 10^4 \pm 8.5 \times 10^4$ |
| S. flexneri SC602 | $7.3 \times 10^6$ | $1.2 \times 10^8 \pm 1.1 \times 10^8$ | $705 \pm 1081$ | $3.1 \times 10^3 \pm 3.6 \times 10^3$ |
| E. coli MACH1 | $4.5 \times 10^6$ | $7.1 \times 10^7 \pm 5.7 \times 10^7$ | $0 \pm 0$ | $859 \pm 1591$ |

TABLE 11c

| Bacteria | Amount Injected | Tumor (CFU/g) | Spleen (CFU/g) | Liver (CFU/g) |
| --- | --- | --- | --- | --- |
| E. coli Top 10 | $3.4 \times 10^6$ | $1.3 \times 10^{10} \pm 8.6 \times 10^9$ | $8.5 \times 10^3 \pm 1.5 \times 10^4$ | $1.0 \times 10^5 \pm 1.6 \times 10^5$ |
| E. coli Nissle 1917 | $4.2 \times 10^6$ | $2.7 \times 10^9 \pm 1.2 \times 10^9$ | $1.6 \times 10^4 \pm 2.6 \times 10^4$ | $8.1 \times 10^4 \pm 8.2 \times 10^4$ |
| E. coli CFT073 UPEC | $4.1 \times 10^6$ | $5.1 \times 10^9 \pm 3.9 \times 10^9$ | $637 \pm 605$ | $1.6 \times 10^5 \pm 1.8 \times 10^5$ |
| E. coli EIEC | $4.0 \times 10^6$ | $2.5 \times 10^{10} \pm 1.6 \times 10^{10}$ | $8.9 \times 10^4 \pm 1.7 \times 10^4$ | $1.7 \times 10^5 \pm 1.8 \times 10^5$ |
| S. flexneri SC602 | $2.8 \times 10^6$ | $1.2 \times 10^9 \pm 3.6 \times 10^8$ | $7.4 \times 10^3 \pm 1.4 \times 10^4$ | $3.7 \times 10^4 \pm 4.3 \times 10^4$ |
| E. coli MACH1 | $2.9 \times 10^6$ | $9.9 \times 10^8 \pm 2.1 \times 10^8$ | $2.0 \times 10^3 \pm 2.6 \times 10^3$ | $2.0 \times 10^7 \pm 4.0 \times 10^7$ |
| L. monocytogenes DaroA/B | $1.3 \times 10^7$ | $5.2 \times 10^6 \pm 7.1 \times 10^6$ | $1.7 \times 10^5 \pm 9.4 \times 10^5$ | $1.3 \times 10^5 \pm 1.5 \times 10^5$ |

The *E. coli* Nissle 1917 strain was tested over a wider range of time points: 3 hours, 1 day, 3 days, 5 days, 11 days and 25 days post-injection. Results are provided in Tables 12 (BALB/c mice) and 13 (Nude mice).

TABLE 12

BALB/c mice

| Time post-injection | Tumor (CFU/g) | Spleen (CFU/g) | Liver (CFU/g) |
|---|---|---|---|
| 3 hours | $1.2 \times 10^3 \pm 4.2 \times 10^2$ | $2.9 \times 10^3 \pm 2.3 \times 10^3$ | $1.5 \times 10^4 \pm 3.3 \times 10^3$ |
| 1 day | $2.6 \times 10^8 \pm 9.8 \times 10^7$ | $0 \pm 0$ | $0 \pm 0$ |
| 3 days | $9.8 \times 10^8 \pm 6.1 \times 10^8$ | $0 \pm 0$ | $51 \pm 100$ |
| 5 days | $1.5 \times 10^9 \pm 7.4 \times 10^8$ | $0 \pm 0$ | $56 \pm 110$ |
| 11 days | $9.2 \times 10^8 \pm 8.6 \times 10^8$ | $1.3 \times 10^4 \pm 3.5 \times 10^4$ | $4.1 \times 10^2 \pm 1.2 \times 10^3$ |
| 25 days | $6.9 \times 10^6 \pm 9.0 \times 10^6$ | $0 \pm 0$ | $0 \pm 0$ |

TABLE 13

Nude mice

| Time post-injection | Tumor (CFU/g) | Spleen (CFU/g) | Liver (CFU/g) |
|---|---|---|---|
| 3 hours | $5.7 \times 10^2 \pm 4.2 \times 10^2$ | $7.0 \times 10^2 \pm 1.1 \times 10^3$ | $7.7 \times 10^3 \pm 2.4 \times 10^3$ |
| 1 day | $2.5 \times 10^8 \pm 2.1 \times 10^8$ | $0 \pm 0$ | $46 \pm 93$ |
| 5 days | $5.0 \times 10^8 \pm 4.6 \times 10^8$ | $0 \pm 0$ | $1.8 \times 10^3 \pm 3.6 \times 10^3$ |
| 11 days | $3.5 \times 10^8 \pm 4.2 \times 10^8$ | $0 \pm 0$ | $0 \pm 0$ |
| 25 days | $1.2 \times 10^9 \pm 6.0 \times 10^8$ | $2.7 \times 10^2 \pm 2.4 \times 10^2$ | $2.1 \times 10^2 \pm 2.1 \times 10^2$ |

Example 6

Comparison of Dosages for Colonization of *E. coli* Nissle 1917 in Tumorous Mice The tumor-colonizing capability and tumor specificity of *E. coli* Nissle 1917 in tumorous mice was assessed. 4T1 tumor cells ($3.3 \times 10^4$ in 100 µl PBS) were injected into the hind leg of 5-7 week old female nude mice (Harlan) 14 days (d) prior to bacterial injection. Various amounts of *E. coli* Nissle 1917 strain were injected intravenously (i.v.) into the mice. Bacterial load was measured 3 days post-injection. Tumors, spleens and livers were surgically removed and analyzed for bacterial load (colony forming units (CFU)/g). The organs were sliced into pieces, homogenized in a MagnaLyser (Roche) in tubes with ceramic beads (Roche) containing 0.5 ml sterile water in portions of about 0.5 g for 2×30 s. Serial dilutions of the homogenized suspensions were made and plated on LB agar plates. Results are provided in Table 14.

TABLE 14

Comparison of CFU for 4T1 tumor colonization in nude mice

| CFU injected | CFU/g tumor at d3 p.i. | CFU/g liver at d3 p.i. | CFU/g spleen at d3 p.i. |
|---|---|---|---|
| $2 \times 10^6$ | $2.4 \times 10^9$ +/− $8.5 \times 10^8$ | $5.6 \times 10^4$ +/− $5.7 \times 10^4$ | $6.7 \times 10^3$ +/− $1.3 \times 10^4$ |
| $2 \times 10^5$ | $1.4 \times 10^9$ +/− $5.9 \times 10^8$ | $1.6 \times 10^3$ +/− $2.4 \times 10^4$ | 0 +/− 0 |
| $2 \times 10^4$ | $1.5 \times 10^8$ +/− $2.1 \times 10^8$ only 2 out of 4 mice colonized | 0 +/− 0 | 0 +/− 0 |
| $2 \times 10^3$ | <100 | 0 +/− 0 | 0 +/− 0 |

The tumor-colonizing capability and tumor specificity of E. coli Nissle 1917 administered via different routes of injection (intravenously (i.v.) intraperitoneally (i.p.) or intratumorally (i.t.)) was assessed. Experimental procedures were identical to the above example, with the exception of the route of administration. $1 \times 10^6$ cfu of E. coli Nissle 1917 was used for each injection. Results are provided in Table 15.

TABLE 15

Tumor colonization after different routes of injection

| Injection | CFU/g tumor at d3 p.i. | CFU/g liver at d3 p.i. | CFU/g spleen at d3 p.i. |
|---|---|---|---|
| i.v. | $9.7 \times 10^8$ +/− $6.7 \times 10^8$ | $7.1 \times 10^4$ +/− $1.1 \times 10^5$ | $4.0 \times 10^3$ +/− $6.3 \times 10^4$ |
| i.p. | $7.5 \times 10^8$ +/− $1.3 \times 10^9$ 2 of 5 mice died within 2 d p.i. Only 2 out of 3 surviving mice had colonized tumors | $1.0 \times 10^4$ +/− $1.7 \times 10^4$ | $1.5 \times 10^3$ +/− $2.0 \times 10^3$ |
| i.t. | $1.3 \times 10^9$ +/− $2.5 \times 10^8$ | $1.2 \times 10^4$ +/− $1.6 \times 10^4$ | $2.9 \times 10^2$ +/− $5.7 \times 10^2$ |

Example 7

Replication and Lux-Expression of E. coli Nissle 1917 in Tumorous Mice

The tumor-colonizing capability of E. coli strain Nissle 1917 and iron-uptake capabilities can be directly visualized by injecting the E. coli strain Nissle 1917 harboring a plasmid encoding the lux operon under control of the arabinose promoter (pDESTR4-R3P$_{BAD}$::luxABCDE::rrnB$_{T1T2}$; SEQ ID NO: 21) into appropriate tumor-bearing animal models, administering an arabinose solution to up-regulate the lux operon, thereby fluorescing the bacteria in the mice and observing light production using a low light imager, Argus-100 (Hamamatsu Photonics, Hamamatsu, Japan).

4T1 tumor cells ($3.3 \times 10^4$ in 100 μl PBS) were injected into the hind leg of 5-7 week old female nude mice (Harlan) 14 days (d) prior to bacterial injection. An overnight culture of approximately $3 \times 10^9$/ml E. coli Nissle 1917 bacteria (i.e., "Nissle bacteria") harboring a plasmid encoding the lux operon under control of the arabinose promoter was diluted 1:50 into fresh 2×YT broth (DIFCO) containing 100 μg/ml ampicillin. $1 \times 10^7$ bacteria were intravenously injected into the tumor-bearing nude mice. After 3 days, 200 μl of a 20% arabinose solution was injected intraperitoneally into the same mice. Six hours (hs) later, lux gene expression was captured using a low light imager.

In tumor-bearing mice that had been injected with Nissle bacteria and administered the arabinose solution, the lux operon was activated and the tumor could be visualized using a low light imager. No adverse impact was observed on the health of the animals tested as a result of the imaging procedures. Thus, the Nissle strain of bacteria localizes to tumors and provides a safe method to visualize tumors in vivo. Additionally, bacterial ferritins (inducible and constitutive) expressed in E. coli are available for evaluation ex vivo and in vivo by MRI for tumor diagnosis.

In a second experiment, the E. coli strain Nissle 1917 containing the related plasmid pBR322DEST P$_{BAD}$::GFP::/luxABCDE::rrnB$_{T1T2}$; SEQ ID NO: 81 was used for the injection. In vitro, this recombinant strain exhibits a strong arabinose sensitive induction of the promoter. Induction of the promoter system results in specific expression of the luxABCDE operon and a $10^5$-fold increase in photon emission from the bacteria. The protocol for injection was similar to that used for the pDESTR4-R3 described above. Briefly, 4T1 tumor cells ($3.3 \times 10^4$ in 100 μl PBS) were injected into the hind leg of 5-7 week old BALB/c mice 14 days prior to bacterial injection. Bacteria were harvested at mid-logarithmic phase, washed, and diluted with PBS prior to injection into the lateral tail vein. At two and four days post-injection, 20 μl of arabinose solution was administered/injected either intravenously or orally at a concentration of 25% L-arabinose.

Light emission from groups of 3 live mice injected with EcN pBR322DEST-P$_{BAD}$::luxABCDE::rrnB$_{T1T2}$ was obtained with an Argus-100 low light imager (Hamamatsu Photonics K.K., Shizuoka, Japan) or an NightOWL LB 981 imaging system (Berthold Technologies, Bad Wildbad, Germany). Photons were collected for 1 min at each time point at day 4 post bacterial injection and administration of 200 μl 25% L-arabinose solution. For each individual mouse, the maximum light emission was set to 100% and all other emission rates were calculated accordingly. The average light emission and standard deviation of the 3 mice was then plotted over time following L-arabinose injection.

After 15 min post i.v. injection of the arabinose inducer, photon emission from the tumors was detectable. The signal strength increased over the next 2-3 hours and then started to decline if no more inducer was injected. When the inducer is administered orally, light emission from the tumors was also detected, but the signal was delayed compared to the intravenous inducer injection. Moreover, photon emission on day 4 was about twice as strong as compared to day 2 following administration of arabinose. Data for relative light emission for arabinose administration 4 days post EcN injection is shown in Table 16.

TABLE 16

| Time Post-Administration of Arabinose | Relative light emission (%) | |
|---|---|---|
| (mins) | i.v. | oral |
| 0 | 6 | 8 |
| 15 | 6 | 4 |
| 30 | 9 | 40 |

TABLE 16-continued

| Time Post-Administration of Arabinose (mins) | Relative light emission (%) | |
|---|---|---|
| | i.v. | oral |
| 45 | 13 | 72 |
| 60 | 27 | 88 |
| 90 | 26 | 70 |
| 120 | 52 | 99 |
| 150 | 69 | 83 |
| 180 | 46 | 92 |
| 210 | 46 | 65 |
| 240 | 64 | 63 |
| 270 | 84 | 49 |
| 300 | 53 | 44 |
| 330 | 60 | 44 |
| 360 | 52 | 30 |
| 390 | 42 | 33 |
| 420 | 52 | 19 |

Example 8

Deletion of msbB Gene in E. coli Nissle 1917

The immunotoxicity of E. coli Nissle 1917, can be modified by deletion of the msbB gene, which encodes a lipid acyl A transferase. The surface lipopolysaccharide that is synthesized in the mutant bacteria lacks the myristic acid moiety of lipid A (Jung et al. Enzyme Microb Technol. 22(5):348-54 (1998) and U.S. Patent Application Publication No. 2005-0255088). The msbB locus of E. coli Nissle 1917 (strain lacking plasmids as described above) was amplified using primers delmsbB5'f and delmsbB3'r using Accuprime Taq (Invitrogen) in accordance with the manufacturer's instructions.

```
delmsbB5'f:
                                      (SEQ ID NO: 65)
5'-CGATCGTCGCGAATTCCTGGCG-3' delmsbB3'r:
                                      (SEQ ID NO: 66)
5'-CGTTACGCCGGTGCACTTTGATA-3'
```

The amplicon was subjected to automated sequencing using the same primers. On the basis of this sequence, primers were designed to create a deletion of the msbB gene by overlapping PCR using the following primers: DmsbB1 (upstream forward), DmsbB2 (upstream reverse), DmsbB3 (downstream forward) and DmsbB4 (downstream reverse).

```
DmsbB1 (SalI):
                                      (SEQ ID NO: 67)
5'-CGTCGCGTCGACCTGGCGCAGGCCAAAGAGATTG-3'

DmsbB2 (EcoRI):
                                      (SEQ ID NO: 68)
5'-AGAGGCTTTTTTAGAATTCCATGCTTTTCCAGTTTCGGATAA-3'

DmsbB3 (EcoRI):
                                      (SEQ ID NO: 69)
5'-CTGGAAAAGCATGGAATTCTAAAAAAGCCTCTCGCGAGG-3'
```

```
-continued
DmsbB4 (SalI):
                                      (SEQ ID NO: 70)
5'-ACGCCGGTCGACTTTGATAGCGCTAATGACGGC-3'
```

The resultant fusion resulted in the replacement of the complete msbB ORF with an EcoRI site (GAATTC). This amplicon was digested with SalI and ligated with pDM4 which had been similarly digested. pDM4 encodes for sacB (lethal to E. coli grown on sucrose) and chloramphenicol. Its replicon is dependent on the lambda PIR protein so this plasmid cannot replicate autonomously in E. coli Nissle (Milton et al. (1996) J. Bact 178(5):1310-1319). The ligation was used to transform E. coli PIR1 (Invitrogen) and the transformants were selected on Luria agar containing chloramphenicol at 30 mg/l. Transformants were picked and grown in LB Cm30 and subjected to miniprep and restriction analysis. A positive clone was chosen and the plasmid was mobilized from E. coli PIR1 into E. coli Nissle by triparental mating, using E. coli HB101 with pRK2013 as a helper strain.

Transconjugants were selected on MacConkey plates containing Cm30. On this medium, Nissle shows faster growth and distinctive red colonies. Red colonies were picked and repeatedly subcultured on LB plates containing 5% sucrose to force the deletion of the sacB gene on the pDM4 plasmid backbone and thus select for double crosses that have the msbB gene deleted. Resultant colonies were subjected to analysis by PCR across the msbB locus, sequencing of resultant amplicons and Southern blotting. A similar approach can be used to delete the ferritin and bacterioferritin genes of the E. coli Nissle msbB deletion strain. Also, homologous recombination using the same vector system can be used to generate constitutive expression of the E. coli ferritin and bacterioferritin genes and the Listeria monocytogenes Dps homolog in Nissle. A suitable target locus for this is downstream of the rpsJ gene, since this operon codes for ribosomal proteins that need to be expressed during growth of the bacteria.

Example 9

Generation of Modified Vaccinia Virus Strains

A. Construction of Modified Vaccinia Viruses

Modified vaccinia viruses were generated by replacing nucleic acid or inserting nucleic acid at several loci in the vaccinia virus genome as follows: the F14.5L (also referred to as F3; see U.S. Patent Publication No. 2005/0031643), thymidine kinase (TK), and hemagglutinin (HA) gene loci. The starting strain for the modified vaccinia virus described herein was vaccinia virus (VV) strain GLV-1h68 (also named RVGL21, SEQ ID No: 72). This genetically engineered strain, which has been described in U.S. Patent Publication No. 2005/0031643, contains DNA insertions in the F14.5L, thymidine kinase (TK) and hemagglutinin (HA) genes. GLV-1h68 was prepared from the vaccinia virus strain designated LIVP (a vaccinia virus strain, originally derived by adapting the Lister strain (ATCC Catalog No. VR-1549) to calf skin (Institute of Viral Preparations, Moscow, Russia, Al'tshtein et al. (1983) Dokl. Akad. Nauk USSR 285:696-699). The LIVP strain (whose genome sequence is set forth in SEQ ID No. 73) from which LV-1 h68 was generated contains a mutation in the coding sequence of the TK gene (see SEQ ID No. 73 for the sequence of the LIVP strain) in which a substitution of a guanine nucleotide with a thymidine nucleotide (nucleotide position 80207 of SEQ ID No. 73) introduces a premature STOP codon within the coding sequence.

As described in U.S. Patent Publication No. 2005/0031643 (see particularly Example 1 of the application), GLV-1h68 was generated by inserting expression cassettes encoding detectable marker proteins into the F14.5L (also designated in LIVP as F3) gene, thymidine kinase (TK) gene, and hemagglutinin (HA) gene loci of the vaccinia virus LIVP strain. Specifically, an expression cassette containing a Ruc-GFP cDNA (a fusion of DNA encoding *Renilla* luciferase and DNA encoding GFP) under the control of a vaccinia synthetic early/late promoter $P_{SEL}$ was inserted into the F14.5L gene; an expression cassette containing DNA encoding beta-galactosidase under the control of the vaccinia early/late promoter $P_{7.5k}$ (denoted $(P_{7.5k})$LacZ) and DNA encoding a rat transferrin receptor positioned in the reverse orientation for transcription relative to the vaccinia synthetic early/late promoter $P_{SEL}$ (denoted $(P_{SEL})$rTrfR) was inserted into the TK gene (the resulting virus does not express transferrin receptor protein since the DNA encoding the protein is positioned in the reverse orientation for transcription relative to the promoter in the cassette); and an expression cassette containing DNA encoding β-glucuronidase under the control of the vaccinia late promoter $P_{11k}$ (denoted $(P_{11k})$gusA) was inserted into the HA gene. Another genetically engineered vaccinia strain, designated GLV-1h22 was produced that has essentially the same genotype as GLV-1h68, with the exception that, in the expression cassette inserted into the TK gene (SEQ ID No. 74), the DNA encoding the rat transferrin receptor is in the correct orientation for transcription from the vaccinia synthetic early/late promoter $P_{SEL}$. GLV-1h22 was constructed using the same method as used to create GLV-1h68, which is described in detail in U.S. Patent Publication No. 2005/0031643, with exception that the expression cassette inserted into the TK locus was generated using the pSC65-TfR transfer vector (also described in U.S. Patent Publication No. 2005/0031643; the parent vector for GLV-1h22 is RVGL19, which is shown in FIG. 1B and described in Example 1 of U.S. Patent Publication No. 2005/0031643).

Insertion of the expression cassettes into the LIVP genome in the generation of strains GLV-1h68 and GLV-1h22 resulted in disruption of the coding sequences for each of the F14.5L, TK and HA genes; accordingly, all three genes in the resulting strains are nonfunctional in that they do not encode the corresponding full-length proteins. As described in U.S. Patent Publication No. 2005/0031643, disruption of these genes not only attenuates the virus but also enhances its tumor-specific accumulation. Previous data have shown that systemic delivery of the GLV-1h68 virus in a mouse model of breast cancer resulted in the complete eradication of large subcutaneous GI-101A, human breast carcinoma, xenograft tumors in nude mice (see U.S. Patent Publication No. 2005/0031643).

1. Modified Viral Strains

Modified recombinant vaccinia viruses containing heterologous DNA inserted into one or more loci of the vaccinia virus genome were generated via homologous recombination between DNA sequences in the genome and a transfer vector using methods described herein and known to those of skill in the art (see, e.g., Falkner and Moss (1990) *J. Virol.* 64:3108-2111; Chakrabarti et al. (1985) *Mol. Cell. Biol.* 5:3403-3409; and U.S. Pat. No. 4,722,848). In these methods, the existing target gene in the starting vaccinia virus genome is replaced by an interrupted copy of the gene contained in the transfer vector through two crossover events: a first crossover event of homologous recombination between the vaccinia virus genome and the transfer vector and a second crossover event of homologous recombination between direct repeats within the target locus. The interrupted version of the target gene that is in the transfer vector contains the insertion DNA flanked on each side by DNA corresponding to the left portion of the target gene and right portion of the target gene, respectively. The transfer vector also contains a dominant selection marker, e.g., the *E. coli* guanine phosphoribosyltransferase (gpt) gene, under the control of a vaccinia virus early promoter (e.g., $P_{7.5kE}$). Including such a marker in the vector enables a transient dominant selection process to identify recombinant virus grown under selective pressure that has incorporated the transfer vector within its genome. Because the marker gene is not stably integrated into the genome, it is deleted from the genome in a second crossover event that occurs when selection is removed. Thus, the final recombinant virus contains the interrupted version of the target gene as a disruption of the target loci, but does not retain the selectable marker from the transfer vector.

Homologous recombination between a transfer vector and a starting vaccinia virus genome occurred upon introduction of the transfer vector into cells that have been infected with the starting vaccinia virus. A series of transfer vectors was constructed as described below and the following modified vaccinia strains were constructed: GLV-1h82 and GLV-1h83. The construction of these strains is summarized in the following Table, which lists the modified vaccinia virus strains, their respective genotypes, as well as the transfer vectors and parental strains (previously described GLV-1h22 and GLV-1h68) used to engineer the viruses:

TABLE 17

Generation of engineered vaccinia viruses

| Name of Virus | Parental Virus | VV Transfer Vector | Genotype |
|---|---|---|---|
| GLV-1h22 | — | — | F14.5L: $(P_{SEL})$Ruc-GFP<br>TK: $(P_{SEL})$TrfR-$(P_{7.5k})$LacZ<br>HA: $(P_{11k})$gusA |
| GLV-1h68 | — | — | F14.5L: $(P_{SEL})$Ruc-GFP<br>TK: $(P_{SEL})$rTrfR-$(P_{7.5k})$LacZ<br>HA: $(P_{11k})$gusA |
| GLV-1h82 | GLV-1h22 | pNCVVhaT-ftn | F14.5L: $(P_{SEL})$Ruc-GFP<br>TK: $(P_{SEL})$TrfR-$(P_{7.5k})$LacZ<br>HA: $(P_{SEL})$ftn |
| GLV-1h83 | GLV-1h68 | pNCVVhaT-ftn | F14.5L: $(P_{SEL})$Ruc-GFP<br>TK: $(P_{SEL})$rTrfR-$(P_{7.5k})$LacZ<br>HA: $(P_{SEL})$ftn |

Briefly, these strains were generated as follows (further details are provided below):

GLV-1h82 was generated by insertion of an expression cassette encoding *E. coli* ferritin under the control of the vaccinia $P_{SEL}$ promoter into the HA locus of strain GLV-1h22 thereby deleting the gusA expression cassette at the HA locus of GLV-1h22. Thus, in strain GLV-1h82, the vaccinia HA gene is interrupted within the coding sequence by a DNA fragment containing DNA encoding *E. coli* ferritin operably linked to the vaccinia synthetic early/late promoter GLV-1h83 was generated by insertion of an expression cassette encoding *E. coli* ferritin under the control of the vaccinia $P_{SEL}$ promoter into the HA locus of starting strain GLV-1h68 thereby deleting the gusA expression cassette at the HA locus of GLV-1h68. Thus, in strain GLV-1h83, the vaccinia HA gene is interrupted within the coding sequence by a DNA fragment containing DNA encoding *E. coli* ferritin operably linked to the vaccinia synthetic early/late promoter.

2. VV Transfer Vectors Employed for the Production of Modified Vaccinia Viruses

The following vector was constructed and employed as described below to generate the recombinant vaccinia viral strains. The pNCVVhaT-ftn vector was employed for insertion of an expression cassette encoding *E. coli* ferritin under the control of the vaccinia $P_{SEL}$ promoter into the vaccinia HA locus Vector pNCVVhaT-ftn (SEQ ID No. 75) was employed to develop strains GLV-1h82 and GLV-1h83 having the following genotypes: F14.5L: ($P_{SEL}$)RUC-GFP, TK: ($P_{SEL}$)TrfR-($P_{7.5k}$) LacZ (strain GLV-1h82), HA: ($P_{SEL}$)ftn, and F14.5L: ($P_{SEL}$)Ruc-GFP, TK: ($P_{SEL}$)rTrfR-($P_{7.5k}$)LacZ (strain GLV-1h83), HA: ($P_{SEL}$)ftn. Strains GLV-1 h82 and GLV-1h83 were generated by inserting DNA encoding *E. coli* ferritin (ftn) (SEQ ID No. 76) operably linked to the vaccinia virus synthetic early/late promoter ($P_{SEL}$) (SEQ ID No. 77) into the HA locus of starting strains GLV-1h22 and GLV-1h68, respectively, thereby deleting the gusA expression cassette at the HA locus of these starting strains. Vector pNCVVhaT-ftn contains a DNA fragment encoding *E. coli* ferritin operably linked to the vaccinia synthetic early/late promoter($P_{SEL}$), sequences of the HA gene flanking the ($P_{SEL}$)ftn DNA fragment, the *E. coli* guanine phosphoribosyltransferase (gpt) gene under the control of the vaccinia virus $P_{7.5kE}$ promoter for transient dominant selection of virus that has incorporated the vector, and sequences of the pUC plasmid.

To generate vector pNCVVhaT-ftn, DNA encoding *E. coli* ferritin (ftn) was amplified from genomic DNA of *E. coli* Top10 (Invitrogen, Carlsbad, Calif.) using the following primers:

```
5'SSEL-ftn-VV3
                                      (SEQ ID No. 78)
(5'-AAAGATAAGCTTAAAAATTGAAATTTTATTTTTTTTTTTGGAATA TAAATACCATGCTGAAACCAGAAATGATTGAA-3')
and 3'ftn-VV2
                                      (SEQ ID No. 79)
(5'-ATAATAGGATCCTTAGTTTTGTGTGTCGAGGGT-3').
```

Primer 5'SSEL-ftn-VV3 introduces a HindIII site, the $P_{SEL}$ promoter sequence for vaccinia virus synthetic strong early/late expression, and a Kozak sequence (ACC) in front of the start codon of ftn. 3'ftn-VV2 introduces a BamHI restriction site. The PCR product as well as the plasmid pNCVVhaT (SEQ ID No. 80) were digested with BamHI and HindIII, ligated, and transformed into *E. coli* Top 10 to yield pNCV-VhaT-ftn (SEQ ID No. 75). This final cloning step places the ($P_{SEL}$)ftn expression cassette between the left and right HA gene flanking sequences in pNCVVhaT and eliminates the non-coding DNA that is located between these flanking sequences in pNCVVhaT.

3. Preparation of Recombinant Vaccinia Viruses

CV-1 cells, grown in DMEM (Mediatech, Inc., Herndon, Va.) with 10% FBS, were infected with GLV-1h68 or GLV-1h22 at m.o.i. of 0.1 for 1 hr, then transfected using Lipofectamine 2000 or Fugene (Roche, Indianapolis, Ind.) with 2 µg of the corresponding transfer vector (see, Table above). Infected/transfected cells were harvested and the recombinant viruses were selected using a transient dominant selection system and plaque purified using methods known in the art (see, e.g., Falkner and Moss, *J. Virol.*, 64, 3108-3111 (1990)). Isolates were plaque purified five times with the first two rounds of plaque isolation conducted in the presence of mycophenolic acid, xanthine and hypoxanthine which permits growth only of recombinant virus that expressing the selectable marker protein, i.e., *E. coli* guanine phosphoribosyltransferase (gpt), under the control of the vaccinia $P_{7.5kE}$ promoter. As described herein, each of the transfer vectors used in the generation of the GLV-1h series of recombinant vaccinia virus contained a ($P_{7.5kE}$)gpt expression cassette. Thus, growth of the virus in the presence of the selection agents enabled identification of virus in which the first crossover event of homologous recombination between the transfer vector and the parental strain genome had occurred. Subsequent growth of the isolates in the absence of selection agents and further plaque purification yielded isolates that had undergone a second crossover event resulting in deletion of the DNA encoding guanine phosphoribosyltransferase from the genome. This was confirmed by the inability of these isolates to grow in the presence of selection agents.

4. Verification of Vaccinia Virus Strain Genotypes

The genotypes of the modified vaccinia virus strains were verified by PCR and restriction enzyme digestion. Lack of expression of the gusA gene in GLV-1h82 and GLV-1h83 was confirmed by X-GlcA staining of the infected cells.

B. Vaccinia Virus Purification

Ten T225 flasks of confluent CV-1 cells (seeded at $2 \times 10^7$ cells per flask the day before infection) were infected with each virus at m.o.i of 0.1. The infected cells were harvested two days post infection and lysed using a glass Dounce homogenizer. The cell lysate was clarified by centrifugation at 1,800 g for 5 min, and then layered on a cushion of 36% sucrose, and centrifuged at 13,000 rpm in a HB-6 rotor, Sorvall RC-5B Refrigerated Superspeed Centrifuge for 2 hours. The virus pellet was resuspended in 1 ml of 1 mM Tris, pH 9.0, loaded on a sterile 24% to 40% continuous sucrose gradient, and centrifuged at 26,000 g for 50 min. The virus band was collected and diluted using 2 volumes of 1 mM Tris, pH 9.0, and then centrifuged at 13,000 rpm in a HB-6 rotor for 60 min. The final virus pellet was resuspended in 1 ml of 1 mM Tris, pH 9.0 and the titer was determined in CV-1 cells (ATCC No. CCL-70).

Example 10

Effects of Ferritin-Expressing Viruses on Survival and Tumor Growth In Vivo Effects of Viruses Administered to Female Nude Mice on S.C. Human Breast Tumor Xenografts The in vivo effects of GLV-1h22, GLV-1h68, GLV-1h82, and GLV-1h83 were evaluated using the mouse GI-101A breast cancer model. Tumors were established in nude mice by subcutaneously injecting GI-101A human breast carcinoma cells (s.c. on the right lateral thigh; $5\times10^6$ cells; GI-101A cells: Rumbaugh-Goodwin Institute for Cancer Research Inc. Plantation, Fla.; U.S. Pat. No. 5,693,533) into female nude mice (Hsd:Athymic Nude-Foxn1$^{nu}$; Harlan, Indianapolis, Ind.) (n=4-8). Thirty eight days following tumor cell implantation, eight groups of mice were injected intravenously with $5\times10^6$ PFU of GLV-1h22, GLV-1h68, GLV-1 h82, and GLV-1h83, respectively, into the femoral vein. Tumor volume (mm$^3$) was measured at 39, 47, 54, 62, 68, 75, and 83 days post-cancer cell injection. Results of median tumor volume are provided in Table 18.

TABLE 18

Median tumor volumes at different time points after i.v. injection of virus strains into nude mice bearing GI-101A tumors

| Days post-implantation of tumor cells | Median tumor volume (mm$^3$) | | | |
|---|---|---|---|---|
| | GLV-1h22 | GLV-1h68 | GLV-1h82 | GLV-1h83 |
| 39 | 412.9 | 350.2 | 353.4 | 392.25 |
| 47 | 750.4 | 722.3 | 1081.2 | 1222.25 |
| 54 | 1154.3 | 1301.45 | 1075.3 | 1168.75 |
| 62 | 1424.4 | 1390.35 | 1319.2 | 1686.05 |
| 68 | 1849.8 | 1581.15 | 1608.9 | 2061.5 |
| 75 | 1907.5 | 1528.95 | 1211.8 | 1856.35 |
| 83 | 1973.6 | 1405.5 | 1017.8 | 1824.35 |
| 89 | 1887.6 | 1181.4 | 855.9 | 1392.0 |

Example 11

Resonance Imaging of Viruses Expressing Iron Binding Proteins

Expression of iron binding proteins can enhance the imaging properties of viruses for in vivo detection. Vaccinia viral strains expressing the iron binding proteins, such as a ferritin and a transferrin receptor were tested for the ability to be detected in vivo using magnetic resonance imaging (MRI). Three strains were tested (GLV-1h22, GLV-1h82, and GLV-1h83) and compared to a control strain (GLV-1h68) that does not express the iron binding proteins. GLV-1h22 expresses the transferrin receptor, GLV-1h82 expresses both the transferrin receptor and E. coli ferritin, and GLV-1h83 expresses E. coli ferritin.

Tumors were established in athymic nu-/nu-mice by subcutaneously injecting $5\times10^6$ cells GI-101A human breast carcinoma cells subcutaneously on the right lateral thigh of female nude mice. At 30 days post tumor cell implantation, mice were i.v. injected with different vaccinia virus strains or PBS control into the lateral tail vein. At 14 days later (44 days post tumor cell implantation), mice were perfused using 4% formaldehyde. Colonization of VV was confirmed by GFP expression in the tumor. Tumors were then excised and MRI was performed (Spin echo sequence TR: 1200 ms, TE: 35 ms, rat coil (UCSD) 7T GE small animal MRI scanner). The resulting pictures were analyzed and the mean grey level of each tumor was determined. The results for the grey levels are shown in Table 19. Expression of the ferritin or the transferrin receptor enhanced the MRI contrast in the tumor tissue compared to the uninfected and GLV-1h68 controls. The co-expression of ferritin with the transferrin receptor, however, did not increase the effect. Expression of ferritin alone appeared to have the greatest effect, which suggests that there may be an attenuating effect on gene expression when additional expression cassettes are added to the virus or an interference effect of expressing a human transferrin receptor in a mouse cell. Nonetheless the experiments establish that expression of iron binding proteins or iron transporters is useful for detection of tumors.

TABLE 19

| | Grey Level | Standard Deviation | Mean |
|---|---|---|---|
| PBS control (uninfected) | 111 | 33 | 108 |
| GLV-1h68 | 100 | 26 | 99 |
| GLV-1h22 (hTfR) | 85 | 25 | 83 |
| GLV-1h82 a (ftn, hTfR) | 85 | 25 | 85 |
| GLV-1h82 b (ftn, hTfR) | 83 | 28 | 81 |
| GLV-1h83 (ftn) | 74 | 30 | 73 |

Since modifications will be apparent to those of skill in this art, it is intended that this invention be limited only by the scope of the appended claims.

SEQUENCE LISTING (81 sequences)

SEQ ID NO: 1 - DNA, 6646 bp, Artificial Sequence
  Plasmid ColE1
  ref <308>: DATABASE ACCESSION NUMBER: NC_001371
  ref <309>: DATABASE ENTRY DATE: 2005-01-25
ttctatgctcctatattgataagaataaacttaatactataaatgaggtgttagggatttaattattctttattgatataaaaagtcctagcaatccaaatgggattgctaggaccaaacaaagtagattatatagcataaataggtttaattttgctacgggggcgttatttaggttttttcttctttcgaaaaaatctttctttatgaagttaaaagctatgtattcaatagcatattttgaatatggacatagaatagtgcttatcactattgcatatagcatcttatctgacacaaggaaataatacccttcgctgttttttgttataaggtatatatatataagtgtgcagtacaggccaaataaaatattttttatgtagtatcttaagctcataaattaaacctcgccatatattcttttcattttataaggatcgagttatgaggaaaagattttttgtgggaatattcgcgataaacctccttgttggatgtcaggctaactatatacctgatgttcagggagggaccatcgcaccatcctcctcttctaaactgacggggatcgcggttcagtagaaaagattaaaggatcttcttgagatcctttttttctgcgcgtaatctgctgcttgcaaacaaaaaaaccaccgctaccaacggtggtttgtttgccggatcaagagctaccaactctttttccgaaggtaactggcttcagcagagcgcagataccaaatactgtccttctagtgtagccgtagtcgggccactacttcaagaactctgtagcaccgtttgtgccatcatcgctctgctaatccggttaccagtggctgctgccagtggcgttaaggcgtgccttaccgggttggactcaagacgatagttaccggataaggcgcagcggtcgggctgaacggggggttcgtgcacacagcccagcttggagcgaacgacctacaccgaactgagataccaacagcgtgagctatgagaaagcgccacgcttcccgaagggagaaaggcggacaggtatccggtaagcggcagggtcggaacaggagagcgcacgagggagcttccagggggaaacgcctggtagctttatagtcctgtcgggtttcgccacctctgacttgagcgtctatttttgtgatgctcgtcaggggggcggagcctatggaaaaacgcctgctacgtggccttcttcctgttcctggtcttttgctcacatgttctttccggccttatcccctgattctgtggataactgtgttaccgtttttgtgtgagtcagtaccgctcgccgcagtcgaacgaccgagcgtagcgagtcagtgagcgaggaagcggaaaagcgcctggacgtgcattttctccttacgcatctgtgcggcatttcacacccggcatggcgtacttttcatacaatccgcactgatgccgcatggttaagccagtatacactccgctatcgctacgtgactgggtcagggctgcgccccgacacccgctaaaacctgctgacgcgccctgacgggcttgtcagctcccggcatccgctcacagacaagctgtgaccgtctccgggagctgcatgtgtcagaggttttcaccgtcatccccgaaacgtgcgaggcagctgcggtaaagctcatcggcgtggtcgtgaagcgattcacaaatatcggcctgttcatctgcgtccagttcgttgagcttctccagcagcgttaatgtctggcttctgataaagcgggccatgttaagggcggttttttcctgtttagtcactgatgcctccgtgtaagggggatttctgttcatggggtaatgataccgatgaaacgcgagaggatgctcacaatacgggttactgatgatgaacatgcccggttacttgaacgctgtgagggtaaacaactggcggtatggatgcggcgggtctgcctgggggagccggttgcccgttccggaaaactgccgacactggcaccgccgttactgcgtcagctggccgccatcggaaataacctgaatcagacagcccgtaaggtgaacagcgggcagtggtcttccggtgaccgggttcaggtggtggccgcactgatggccatcggggatgagctgcgccggctgcgtctggctgtcagggaacagggggcgcgggatgatagttaaatttcatgccaggggaaaaggtggtggcagtggtccggttgattacctgctggggagggagcgtaaccgcgaaggcgcaacggtgcttcagggtataccggaagaagtccgggaactcatcgatgccacgccatttgcgaagaaatacacgtccggtgttctgtcgttcgcggagaaggagctgccgccgggaggacgtgaaaaagtgatggcgagctttgagcgtgtactgatgcccggtctcgaaaaaaatcagtacagcatcctgtgggtggagcaccaggacaagggacggcttgagctgaattttgtcattccgaacatggagctacagaccggaaaacgcctccagccgtactacgaccgcgcagacaggcctagaattgatgcttggcagacgctgttaaatcaccattacgggctgcatgacccgaacgccccggagaaccgcaggacgctgacactccctgataacctgcctgaaacgaaacaggcgcttgctgagggcgtcacgcgaggtatagatgcactttaccatgccggagagataaaaggccgtcaggatgtgattcaggcgctcactgaggcggggctggaagtggtcagggtgacgcgaagcagtatcagcattgcagatccgaacggcgggaagaatatcaggctgaaaggagcattttatgagcaatcttttgcagacgggcgcggagttcgagaaaaagctgaaagagagagccgaatctacagagaaaatgctgaacaacgagttcaggaggctcggcgaatctgtaagcgaggctgtgacatcaaacgagacgaaaatcagagacgctatagccctgttcacagcctcgacagaggaatcgctggaaaaacaccgggaaggggtgaaagaggcgatgatgcagcacaggagggacgtgttaaagctggcagggaatacgggcatgatgttactggggatagtctttctcctgtttaccgcgagtggcgggacgctctggtatcttggagggaggatacaggcgaacctggaagaaatcaggaagcaggaagagacattgcagaaactgaacgcgaagacatggggcgtggagtttgtgcaggacgggaacaggaaattccttgtccttccgtacgggaaatcagcggaggtgattccctttcaggggaaagagtgggtacatctgaaggagtgacacagagtgacagagctggaaacacatttgctgaacgccttagagcagctgcaacaggactatatgcagcggctgagcgaatgggagagcgccttcgtggaattgcagaagatgttttcgcttacgcaacgggacaacgcgatgctgaacgagcgggtcatgcagttgagtcagcaggtgcaacacttgagcgagcagacagaacgcttgagccagttatacagcgagaactggagataagagaggaacggctgatacaggagcgcgaacatgtgttatccctagaacgggagcgtcagccggaaatacaggaacgcacgctggatggcccttcgctgggatggtgaaaccatgaaaaatggcagcttcagtggattaagtgggggtaatgtggcctgtaccctctggttgcataggtattcatacggttaaaatttatcaggcgcgatcgcgcagtttttagggtggtttgttgccatttttacctgtctgctgccgtgatcgcgctgaacgcgttttagcggtgcgtacaattaagggattatggtaaatccacttactgtctgccctcgtagccatcgagataaaccgcagaaatcgtgtcagccagcagcctggattttttcggggtaaggtctttgctgcggtaatcagtacccgcaaattgagttgtgccccggagtgagtttaaaaattcttggctgtgaaactgctgaatgcgttgttgcacatcactccgtgattttcctgtcgctttgtctttagctcccatatcccagaactgccgaaaaaaaggcaccatcattcgtgttgtgtcggctttttgggtggaaaagttgggatcaaaaccgtcatcagaagcatatacgtaatgccgggtatgttgttccacgctgccctttggggtacaggctgtgagagctactgttgctgttatcatggcgataagacaaagtttgtttccggtacgtctcatgagtgtctccctaccttaaagtatttattctcggtgagttattatccgaagactattttatcatcagtctctgacagcgttcagcgaccgaacaacctggaccagaatccccgtttcttttccagttccagtgcctgcctgagctgggctatctcattttgtagctgttcccgttctgcttcctggcgtctgcgatccatatcctgtgcctgtttatcctcaagcatcagcgtcaggcattgtttcagctcattcagttcccggagaatgcgttctgtctgctgatcatgtggattttctgcatgtccctcactgtgcctttctggtgtctcattctgctttaattcgccgtatgcccggatcagttcactggtttcaaactcccgtcgtccgtccctgccggtacggtaactgacaaggcctccgcgcatatcacggtaaaactgtgaacgcgatctgcctgtcatttttagtgcgtcccggagtgtgtgccatgccataaagtgacagtgtcccatagatgtctcatctcatagtttcagtaaaacataatgaggtctgagaacggtaatgtttgtgctggtttttgtggcatcgggcgagaatagcgcgtggtgtgaaagactgtttttttgatcgttttcacaaaaatggaagtccacagtcttgacagggaaaatgcagcggcgtagcttttatgctgtatataaaaccagtggttatatgtacagtatttatttttaacttattgttttaaaagtcaaagaggattttataatggaaaccgcggtagcgtactataaagatggtgttccttatgatgataagggacaggtaattattactcttttgaatggtactcctgacgggagtggctctggcggcggaggtggaaaaggaggcagtaaaagtgaaagttctgcagctattcatgcaactgctaaatggtctactgctcaattaaagaaaacacaggcagagcaggctgcccgggcaaaagctgcagcggaagcacaggcgaaagcaaaggcaaacagggatgcgctgactcagcgcctgaaggatatcgtgaatgaggctcttcgtcacaatgcctcacgtacgccttcagcaacagagcttgctcatgctaataatgcagctatgcaggcggaagcagagcgtttgcgccttgcgaaagcagaagaaaaagcccgtaaagaagcggaagcagcagaaaaggcttttcaggaagcagaacaacgacgtaaagagattgaacgggagaaggctgaaacagaacgccagttgaaactggctgaagctgaagagaaacgactggctgcattgagtgaagaagctaaagctgttgagatcgcccaaaaaaaactttctgctgcacaatctgaagtggtgaaaatggatggagagattaagactctcaattctcgtttaagctccagtatccatgcccgtgatgcagaaatgaaaacgctcgctggaaaacgaaatgaactggctcaggcatccgctaaatataaagaactggatgagctggtcaaaaaactatcaccaagagccaatgatccgcttcagaaccgtcctttttttgaagcaaccagacgacgggttggggccggtaagattagagaagaaaaacaaaaacaggtaacagcatcagaaacacgtattaaccggataaatgctgatataactcagatccagaaggctatttctcaggtcagtaataatcgtaatgccggtatcgctcgtgttcatgaagctgaagaaaatttgaaaaaagcacagaataatctccttaattcacagattaaggatgctgttgatgcaacagttagcttttatcaaacgctgactgaaaaatatggtgaaaaatattcgaaaatggcacaggaacttgctgataagtctaaaggtaagaaaatcggcaatgtgaatgaagctctcgctgcttttgaaaaatacaaggatgttttaaataagaaattcagcaaagccgatcgtgatgctatttttaatgcgttggcatcggtgaagtatgatgactgggctaaacatttagatcagtttgccaagtacttgaagattacggggcatgtttcttttggatatgatgtggtatctgatatcctaaaaattaaggatacaggtgactggaagccactatttcttacattagagaagaaagctgcagatgcaggggtgagttatgttgttgctttactttttagcttgcttgctggaactacattaggtatttggggtattgctattgttacaggaa

SEQ ID NO: 2 - DNA, 54 bp, Escherichia coli
  araBAD promoter
  ref <301>: AUTHORS: Ogden et al.
  ref <303>: JOURNAL: Proc. Natl. Acad. Sci. USA
  ref <304>: VOLUME: 77
  ref <305>: ISSUE: 6
  ref <306>: PAGES: 3346-50
  ref <308>: DATABASE ACCESSION NUMBER: K00953
  ref <309>: DATABASE ENTRY DATE: 2002-12-16
gattagcggatcctacctgacgctttttatcgcaactctctactgtttctccat

SEQ ID NO: 3 - DNA, 309 bp, Bacillus subtilis
  rpsJ (PS10)
  ref <301>: AUTHORS: Li et al.
  ref <303>: JOURNAL: J. Bacteriol.
  ref <304>: VOLUME: 179
  ref <305>: ISSUE: 22
  ref <306>: PAGES: 7046-7054
  ref <307>: DATE: Nov-1997
  ref <308>: DATABASE ACCESSION NUMBER: U43929
  ref <309>: DATABASE ENTRY DATE: 1997-11-20
atggcaaaacaaaaaattcgtattcgtttgaaagcatatgatcatagaatccttgatcaatctgcagagaagattgttgaaacggcaaaacgttctggtgccagcgtatctggtccgattccgttgccaactgaaaaatcagtttacacaatccttctggcggtgcacaaatacaaagattctcgtgagcaatttgaaatgcgtacacataaacgtttaatcgacattgtgaacccaacaccacaaactgttgatgctcttatgcgattagacttaccatctggtgtcgatatcgaaattaaactttaa

SEQ ID NO: 4 - DNA, 166 bp, Escherichia coli
  ompA promoter
gtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggat

SEQ ID NO: 5 - protein, 361 aa, Artificial Sequence
  SA-B1/ompA
MKKTAIAIAVALAGFATVAQAAPKDNTWYTGAKLGWSQYHDTGLIGQRLEICQNVCYYLGTLNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 6 - protein, 361 aa, Artificial Sequence
  SA-B3a/ompA
MKKTAIAIAVALAGFATVAQAAPKDNTWYTGAKLGWSQYHDTGLIGQTVLICMNICWTGETQNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 7 - protein, 361 aa, Artificial Sequence
  SA-B3b/ompA
MKKTAIAIAVALAGFATVAQAAPKDNTWYTGAKLGWSQYHDTGLIGQGVLICMNICWTGETQNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 8 - DNA, 823 bp, Escherichia coli
  Ferritin (ftn/rsgA)
  ref <308>: DATABASE ACCESSION NUMBER: X53513
  ref <309>: DATABASE ENTRY DATE: 1991-05-16
gatcttcgctgattaaagaaatagcggtaatgcgttttattcccattcgtatttttaataattgaagtttatattttaccttttgcaaataataaaataacaaattatagtgacgccacagcaacaaatataacctttgtggagcactatcatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaatgctctccggcggcaggtttactgccgccgtttcaaatcagtgacggcaaatcttactctgatcggtcgaaaaaccgtctttcgaaggtataaatttgccttttgctgccagaaacgctaccagctctcccgctgtcatcccttctgccgagcaggtgtgaaaacgtgcctgtt

SEQ ID NO: 9 - DNA, 1440 bp, Escherichia coli
  bacterioferritin
  ref <308>: DATABASE ACCESSION NUMBER: L28106
  ref <309>: DATABASE ENTRY DATE: 1995-01-12
ctgcagttaatggaggcgaactatagccagaagcaaaactcgctgaccttaaaaatgagtgctaagagtgaagctaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcactggcggttctctcgctcggcgttttttgttggcttggggtgataaaaccgatagatacctacattgcagagcatcagtcccacgcgcaaaaaattaagaaggacatcaaatggatgcaggatcaagcgagcacccatggtttactcggtcatcctgcgcttacgcagcccatcaaaaatatccttctcgaggaagcaaaacgtgagaatttggctatcacgctggaaaacggcccggacaatactctgacaattcatcctgtcacagctcccctcgaaaacgtctcccgctggctcactacggcacaggtaacatacggtattgttattgaagaccttcagtttactcttgccggaaacgaagagatcaccctcaggcatttgtccttcagggagcaacaataatgacaatgctactgccgctcttcattctggttggttttattgcagattattttgttaatgccatcgcctatcacctctcgccgttggaggataaaacggcgttaacgtttcgccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaaccgggagggttctccctcccgacacggctcaaccttcttcgcggatctgtgcttgcagataattttgcaggcccatcttctgaatcagatcaagttccgtttccagccagtcgatatggccttct

SEQ ID NO: 10 - DNA, 201 bp, Artificial Sequence
  rrnB ribosomal transcription terminators T1 and T2
acgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgc

SEQ ID NO: 11 - DNA, 43 bp, Artificial Sequence
  Translation initiation region
  variation 4: n is a, t, c, or g
  variation 5: n is a, t, c, or g
  variation 24: n is a, t, c, or g
  variation 37: n is a, t, c, or g
  variation 38: n is a, t, c, or g
  variation 39: n is a, t, c, or g
  variation 40: n is a, t, c, or g
  variation 41: n is a, t, c, or g
  variation 42: n is a, t, c, or g
ttannaaggaggaataaaaaatgntaaaaaacaaatnnnnnnc

SEQ ID NO: 12 - DNA, 97552 bp, Escherichia coli
  Nissle 1917, Genomic Island I
  ref <308>: DATABASE ACCESSION NUMBER: AJ586887
  ref <309>: DATABASE ENTRY DATE: 2005-04-15
ataggcgtatcacgaggccctttcgtcttcaagaattcgcggccgcaattaaccctcactaaagggatccacgatttttccacctcaacctgatgacgtttgcgctggaaggcgatgactgcgtcgtagaattcgtcaaagcaccaggtataaccaaaggtgccgtgctccacgatgcgccggaaaccgtcaatcaccgcaggcggtgaggtgaaatccatatcggctatccacagggggataaaggactccgggacgtcaccgaaacgcgagcaaacaaaggcatggtcccatttacggcacttatcactttgacgctcaatgattttgtcgaaatcaaacatcactcctcctgttaaattaaggcttcaatgccggttttgacgctctgtacctgcgctccgatgatcacctgcacgctatgcgcatcaagcatcgatcatcgcgctgcgtacgccggcgtgaaccttacggcgaatgtcatccaacgattcgtgatgatcgagatgcagtgctagcggcatgtcgtaagtgatcgaatacgcactgcacagggcgtagatctcttccagggcaatatgtttgaacgagccgggggggccccgcgaggagcacgggcgagcgcatttcgctgcacacttcgaggatcgcctggatcgtttcggcgttgtggatgttaaacgtcggtacggcgtaggcgttggcctgcgcatcctgcagaagatatttcgttgagataatgctcataaggggagcctcttaagcccgctatggatgaataatcacaccttgcaccacacggttaatcgtgccgctggcagaggggagatctggcgtattgccaacatgaatcgactgagccagcgcaaagacctgggcgtacatcaggaagcagaacgcctgttccatgtcgataaacgaacgggaaggaggcaacaggatatgcgggcccgcttcgatgatggcatccgtttccaccgcaattgcgatcacgcgcattgcctgacgatcgcggcgcagttctgtcagcagacccaggtcgtactggcgcgtgtaagggtggctggagatgtacaccacgataagcgtttcgctatcgaccagcgattttggtcgcagatgatcaccacccagaatcagcgcatcctgggggaaattcaacgagtcggcgagctgacaaacaaagccgcgaaaatcggcgggcgtcattccggtataaccgctgaactggtccacctgattggaggttgcttcaatcagtaacggcgtttggtttgcactggcgtagcggattgcagcttccagcaccagcggatgtgcggaacaaacggcataaatcccatttgttttgcccgctttgtgctgcctcaccatttctgtcagatgtttcacttgcctctccagttccgattactgcgatattaatctttcgttttgtttcagtttatactgcgtcatggtgagataaaaacaaaacgaaagttgcgggttttctgatctgattcacaaaagaaacataatgaaagtcactaaaacgagagtagcttgcgccaatgggcagtgtgggcttgcatttgcttaatagaaaggcgttaataggcaaaacgaaatgaaacgaaagttttacgaaaggacttactatgagtaataccgacgcttcaggtgagaagcgagtgacaggcaccagcgagcgacgagaacagatcattcagcgtctgcgacagcaagggagtgagcaggttaacgatctgtcggcattgtatggcgtatctactgtgacgatccgcaacgatctggcgtttctggaaaagcaggggatcgctgtgcgtgcctatggtggcgcgttgatctgcgatagcacgacgccgtcagtcgcaatctttttacggtgatcaggctgagcaatcgctgcaaaattaccacttcgatatgctgtttcttggtgtagatgcgatcgatctggagtgcggcatcagcacgcataatgaagatgaagcccgtttaaaccgtcggatgtgcgaagttgcggaacggatcatcgtggtcaccgattccagtaagttcaatcgttccagtttacataagatcattgatactcaacgtatcgacatgatcattgttgatgaaggcattcctgcggatagtctggaaggcctgcgaaaggctggggttgaagtgattctggtcggggagctcgcgtcttcgctgtgattcactatgcccgataaacaagcgttatcgggcataatacaacttgatgtatgaagagaatatcagaccaccggtgccgggttaaacactgccagctggttatgcaatccccattgatccgagaaggttttcttcttcccgctggcgacgtcgagaataaagtggaacaacttccagcccacctcttcaatggtctcttcgccggtagcgatagtgcccgcgttaatatccattaaatcaaaccagcggttcgcctgcccggtgcgggtcgccattttaatgacgggtaccgccatcaggccgtacggcgtaccacggccggtcgtaaacacttgcacggtgatacccgaagccacctgttgcgtgccacagataaaatcgctggctggcgtcgcggcgtaaattaatccgcgtttagtcgggtgttgaccgggcgacagcacttcagcaattgcggttttacccgatttagcaatggagccgagtgccttctttaccacgttggcgaggccgccctttttgttgccccgcgaagggttggcgctgcggtcggttttgcccatatcgggatagttatcgtatcaggccatctcttcgagcagacacctgcccacttcttcattgatggcgcgcggcgttaacagatgaatggcgtcgtgtacatcagtgacttcggagaacatcaccgttgcgccgcagcgcaccagcaggtcagaggcgtagccgacagcggggttagcggtaacgccggagaacgcgtcgctgccaccgcagtgcatgcccaccaccagctcggaggccgggcaggtgacgcgctggcctggttgagtttttccagatggtgtgcggcagcctgcaggatatcgtcgaccattgatttaaagccaacgtgctgttcgtcctgtaggcgtacgatgctggctctgtcgaccgggatgctctgcacatcttccgttcctttctgcaggcgctatggctgtagcttttcgcaaccgagacccaccaccatcacttcgccaccgaagtttgggttcagcgcaatattatggatggtgcgaattggcaccacggcggtcggtgcattaatcgctacgccacagccgtagaggtggttcaagtcgaccactccgtcgatgctcgggtatttcggcagcaggttgcgttcgataattttaaccacgtagttcacaacgtctgccatgcagtgcacgctggtggtaatacccaacaggtttttggtgcccacgctgccgtcggcgttgcggtaaccttcaaaggtgtaatcttccagcggcggcagcggctccggcactttggtcgcccgaggcagggggttaagcggcggcgctttcggcagcgtgaccgtggatttgtcgatccagctgcctttggcgacatcgcgtaccgcgtaaccgataacttcgccatagcgaatgatttcaccattctgaggaaggttgttatcccttttctggcgtattcgtcattccattcgtatccccggtaccggatgtttatatcgtactgtgccggtgcttgcgtgctttcctgcaggtctgcaccgatttaacaaacaaaacttaacagagtctgaaggagtagtatttcgtgcaaataaccgaagcgttattttcagagcagggagacatccggcgttttgttcagcaggcggtggaccactggacgcatctgctggcagtccacttcacactccattcggcagaaggaaatatcaacgggcaacagattcatgcattctgtacttccttttatgaacgtattactgagcgtaatcacacgaccagtccatcatcgccgctggtattacgctggttgcgggaacaactacatggaggagcaacaatacgatgcctgttgctgctcagccagacgagcatttgccatccgcgagccagtgtgacaggtgatgaagcatgttcacaactggtggatttactgcaacagacctggcgggtgataagtgctggcggacaatgtcgggtggaaagttttttttcgggttgcccggcctgatacatcagagcaatacgttgctttaaaaactgctgttcagtctctgatgctatgggttattgcaacaatcatccggtgatggacgggagaaatatcgactcttccgttagtttttacaggctgataaagttttgccagctgaatctttatacggaatactctccagtatgcgtaagagaatttgctttttggaggggggcgacaaccagatggtaaacaaaagaatggttgaatgtggatgaggttcatattcattgattcagattttttgaagaatcaccacatgggatgtccatgtggttgtataactcagggccagcgcttaatgatgatggatgtattaatgccgccaaaggcaaagttgttactctgcaaaaactcacaatcaacctttcgggcttcatgcatgatgtaatccagcgcgccacagttcgggtctggtttattcaggtttagcgtaggcgcaaaccaaccttcgcgcatcatttgcagactcatccaggcttcgagcgcgccacaggcaccaagcgtatgaccaaaataacttttcagcgaggagaccggcacattatcaccgtaaatggttgctgtcgccagactttctgccatatcaccgcgatcggtcgccgtaccatgcgctgaaatatagccgatatcttgtgcacttaacccggcgattttcagcgattgctccatacaatactgcatggtttcgcgctgtggctgggtaatatgtgccgcgtcgcagttagtcgcaaagccgacgatttcaccgtaaatggtcgcgccgcgcgctttggcgtgctccagttcttcgaggatgagcgtacctgcgccttcaccaatcaccagcccgtcgcggttttcatcgaacggtgaaggtgtggttttcggcgcatcattgtgctggctggtggcaaaaagcgtatcaaataccgctgcttctgaagggcataactcttcggcaccaccggcaaccatcaccgtttgataaccatggcgaatggcttcccacgcgtagccgatagcctgactacctgacgtgcaggcgctggaggtcggaatcacccgcccgcgcagtccaaaaaacagcccggtgttaacggcagtagtgtgcggcatcatctgcacataggtggtgccagtgatgttgttcgtgtgcttttccgtcagcatggtggcgaactcgcttaccgggccggtactgccggtcgatgagccgtatgcaatgcccgtttcgccgctggttaatatcggatcgccaatcaaccctgcctgctctaacgccagctcgctggcacgggtcgacatttgcgacacgcggcccatcgcacggatacgcttgcgggtgtagtgctccggcagcgtgaaatcatcaacaggcgcgccaagcagggtgtgcaggccgtcgtaaacctgccactccggcattttgcgcaccgcattttcatacgccagtaagcgtgcagaaacgtcctgccagttttcaccaaaggcagtcacgccgcccattcctgtaatcactacgcgacgtgtcataacatccctccattgatggaaataacctggcgggtgacgtaacccgcaatatcagacattaaatagctggcaagcccggcaacttcttccgcctggcccatgcgtttcatggggatcatcgacattgcctctttcagagcgctctcttccatttcgatcatcccggtatcaataagccctggcgcgatgcaattgacggtgattttgcgcttcgcgagttcgatagccagtgcttttgttgcgccgataattccggctttggcagcgctgtagttcacctggccgcgattgcccattacgccggaaaccgaggacagcgtgatgatgcgcccaccctggcgtgcgccgatcatcggcataatgcacggctgaatgacgttgtagaaactgtcgaggttggtgtggatcaccgcatcccagtcgtcattgcttaaagccggaaaagcggcatcgcgggcgatcccggcgttactgaccacgccgtaccaggcaccatgttgcgcgatctcgtgctccagcacttcccgacactgttcgcggtttgcgacgtcgaaactgagcaaacgcccgttacccccgttggcgacaatggcgttcagcgtttcctgagcgcccgcggcgtcacggtgatagtgaacgccaatgttaaagccgtctgccgccagttggcaggcgatggcgcgaccaatgcctttgctggcaccggtaaccagaactgaacgactcatcaggacgctccttgttgaaacagggtggtaagttcttccgcggtcggctggaaggtgttaatgcggcccgtcgcctcgccgtcgttgatgctgcactcaaaactgccgaagcgatcgtcctgcatcagcagcttgacggtaatagtcagcgtctggcctgcgggcagaatgccagcggtgcaaagcaattcacgcgcgcccagtatcatccctaactcaatactgtttttgccctgctggtggcgatgccagccagaccagacgccgacggtttgcgccatcagttcaagggcaaaccagccagggagattgccgtccgggtcgagaaacggtgccagtacgccactgggcgaaaccgtcacgcggcacaccgcgctgtcatcgctgacgctcaccacgtcttccagcagtaacatgggcgcgtcgtggggcagataagcgccgggggataaatagtggctcacgaaaccctcccgagcagaatgctggcgttattgccgccaaaggcgaaggaattggacaggatcaccggacgtgccagcggctgcggtttttcgataatgccacacggtggcagcgtgggatcgcgcggcgacagactgaagtcctgagcgggcagcggtaaatcacgctgtaaaatcaacatactaattgctgcctcggtaatgcccgctgcgcccagcgtgtgtccggtcaaatgtttggtggagctgcacggtacgcgttcgccaaacagggcgttaaccaccattgattcaatctggtcgttgagctgtgtggcggtgccgtgcaggttgatatagccgacgtcatccggcgtaagctgcgcatcggtcagcgcctgattaatagcgcggatcgctccttcgccctgcggatgcggggctgaaatatggtaagcgtcgctcgattcaccaacgcccagcaacgcgatgggctgcggttcccgggtcagcagcattagccccgccccttcaccaatggtgatacctgcgcggtcacgaccaaacggctgacataaggttggcgacagcgattcgaggctgtgaaaaccgttaatcggcatccggctcagggtgtctgcgccacccacaatggcggcatcgaccagccccgcttcgataagcctgcgcccgctgattatcgctctggcgctggaagagcaggcggttgaaagggtataggccgggccgtcgagcgccagccagtggctgagaaaacgcgacggatcgccgagttcctgttgcgcgtagtgccatgtggtgctcggctgcccgtgggtgcgcaggttaacgtgcgtgtcgccttcatgcaggccggaggtgctggtgccaagtacaatcgcgatgcgctcgcgaccatatttcgctatagcgtcatcaacctgcggctggagctgcgccagcgccgccagcaggatctgattgttgcgcgagcggtgcgcagcgaatttttccgggataagcggaagctcgccatccacgccagccaggaccgcctgcggatgcccctgcaaccagcctgcgcgcgggcgcattccgggagcaacaccgcgagtcaggttggttgcgatttcgtcaaggttatttcccagggcgttgatcatgccgacggcggaaatataaatcatatcagtcacctaagtattgaatggtgatgtggtatttaaagacatgctgctcaatgctgattggcacgcgttttccctggcgattcagataggtgatttccgtgaccagtttgccgctggcgttacgcagctcgcgtttgtcgccgttgtcgcgaagcgtccagcctgtgggaagttgcggttgccaggcgctaatcggccagtggctgagcatcacgtcagccagtacctgacttgcgggcggtaactgtgggacgacgatggattgctcggcgcgtagcccttttgcatcgtaggtcaccagaaacaggcgaatgccgaccgacgacagcccggcaagggtgattttctgatcttcggcattaagcatcactagcagagactgggttttgccgttgaagctgccggtcaacagttgctgggaattgactgcgggtgaaatccccggcgcaggcagcgtgatgagcgtaccaggttgcagccacgcctgcgggcggccttcctgttccggttgcgagtggctacagccagtgaggataagcgtagcggtcagggcgagcgctcgccagaatgtggatttgatcatttttttgttctctttttatcgggcatcgccagcggcgaaagcaggaaggcggtgaaaataccgctcaccagcacaatgccaaaactgctgatggcctgggtggcgctgaataccagcattcccagcgtcagcaaggtggtgagcattgccagcgtgatcgccagtagggaagttaacggtgtaccgcgcggattactgaaaaacagcgtgtaattgatgccgatgccaagcaccagcaccagcgccagcagcgaaaagagattcaccgcctgcccgctaatcgccagcacagccagaccgcagcccagcgaaagcaccgaaggcaccaggctgataaaccctttgcgccagccgaggcgggccactgcgccgcaggcaattactgccagcgccaccagcaacaagccggttaacacataacggtaaagtgcgaacaattcatcaaaggtgtttttgcgatcaacccaggcaatgccacaagggtaatagctggagatttcctgtagcgccgcgctatttttaaccccttcaaccggcaccagcacgccgcttgcgccattttccagcgtcagccacagcagacgccagccttcactggcggggcttgccagccattcatcaaccttcaccggcatggcgttgagatccgggttcactgttgtcagcccggcattttgcagtgcttttgttactgtcggggccgctgttgtcagcagatgtaaatcttcctcctgccgcgcaagggagttcagtggaatggtgcggtatttgctgataagcccgtcttttttcgccttctccagcgaggtggtaaatttctccagtcgccgtaatgtttgctgtggggagtcgccgtaaaccacgaaccatttttgatcgacgctctgcccggtcagggcggtaatggctttctcctgcgccagaatatgctgcggcagcgcctgtaactgcgagatatcgtcatcgacgcgtagcattgacatccccgccagcgaaaacagcgccagcgcgacggacagaccccgcgacagttttttattgcgccgccacgctgccagccagcgtagcatcagcgccatcgccggaaccggacgcaccggcaggccacggcacagccacggatgccagaacaggacggtcagacaggaggcgctcaacccgatggcggcaaaaatcgccatctggcggataccggggaagggggcgagcatcataatcagatatgccgccacggtggtgagcagcgccagcagcagggcattgcgtactttcgccaggctttgccacggcgaaacgtcgttgccgtgcaccatccgctcggtgagataatagagcgtgtagtcagcggaaatgccgataacgctcatgctcatcaccagcgtcatcaggtgtaattcaccgaaaatcaataaagtggcgaccgttcccgccagcgcgccgatgccgatggaaatcacgcaaagcaacaatgggcgcaaagagcggaacaccgccacaatcagtaatatcacccccagcagcgttgccacgcccagggttgagatatcctgcttcgcctgttgactggcgtaatcgctgtaaaataccgtgccgcgcgagagcaactgcgcctgtgggtaacgcgttttcagatccttttccagcgtattcagggtcgtgatgagctggtgggtttgctgcatatcaaacgacgatcccgccagttcaccgtgcagcagataccagtagttgccctggggatcctgcgtcaccagccagccgtccatcagccgcaaacgctggccgtttttcgccatcgccagctgcgagccgcgcattaacatcagcggatcgttttgcagctccttgccgcttaccccggagaatgcggaataaagctgggagaggatccactgcgcctgcgcttcgccgccgttttgcaggcgggcgcgggtgtcggggtcaatcaggccgttgcggtgctgccagaaaaacgctccccacgattgctggctggcggcatccattggtcctttaacgtcgccgagcgcagcggatttttgcagcagcgtcagccactcctgagcgaccctgggattagcctctttaccggggctgaccagccacaccagttggcggtccagacgctgcataaagccgtcattcagcgctgggggaatatcgcccatcacctgtttgggtaacatagccagcacgctactgttcagccgtgattgcggcagcaggatcagcaacgccgccgccatgaccaggcagactagcccccataacagcgcggggcgtttactgggcggcaaaacgttggtgttcgtcatcggtcagttgcgctggcgtcagttgatgttgggtaagagcaatatcggtgcgatcgccctgtttatcattaagttgaatgctctccagataggttttcccggcgagatcgatggtgttgaaaattttatccagcggcgtggtggtcggcgtcaggcgcagcgtccagcggccttcgcctttgtcagcaaattcgacgcggaagttttgttccagcactttgcgatcggcctggaacagcgcgcgcagcaggtggttaaactggaacatctgcgggttgttttctgccgtgatgatttgcggcggctgaccgttgatcacctgcaccatgcgtttatcatccagcaatagctgcatggggaacggtgaggtttgatcccacaataacccctggtcgcgggcgatcaacatctgaccctgagatcgcagcggctgcggcagatctttaatcgtccgggtttgatcaaaatgggcgcggatcaccggttgttcggtaaagcgttgctgaagatcgtccagggtcagggcgctcacaaacgggctaatcagcagcgccagcagcggtaaaaatttcatggtttgactcccatgcgttcaaacagaatatcggggctgacaaagcacagttcgcgactttgctcgtcgaccgcgacctgaatggtgtatccggtggtggcgcgtttgcccgtttcggcatcgaaaatctgatagccaatccgcagacggttttcgaactcttcgatatgcgcacgcacgcggatgcgttgctcaaaggtgagggcgtggcgatatttcacccgcgcatcgaccactggccacaaataaccggactctttcatctgccgatagccgtaattgaactggttgagcagcgcctcgcgggccacttcaaagtagcgaaaatagttaccgtgccaggccacgcccatcatatcgacgtcgtgaaagggaatggtcagctcgacttcagcggtaaatcggggatcgttaagcaccctttactccttgtcctgaatttccggcagttgccagaaatcgaaaaaattaaaccagtcgaggggcgactggagcgcgtaatgttccagacgcgcggcgtagtggtcgatagcgttttgcagcgcctgttggcgttcgccacgcggcaacagcagcgggtcggcaaaggtttcgcagtgaatatgcagcttgccgtgctggcgtagggcgaaaatcagattcaccgggcagcgcaaaatagacgcgagaataaacggcccctgtgggaaaggcgcaggctggcccataaacggactccagcagacgcgccagtcgccgccgcgttgcgggttgacggcgatgcggtcaccgacaatcgccacccattcgccgttatccagcttctctttcagcaggatggcggtttccgggccgatatctgttaccggcatcaggttaatgcctgcctgaggagccatctcctgcattatctgtttaaagcgttgggcgttttcgctaaacaccagcgcgttaatggttttgtagccctgaatttttgccagcgcccggcacacttccacatcgccaagatgcgaggccagcagcaatttgccgcgcggatcgcggacgtcaagcgccgcttctgcgcctggcgcaaacagcacatcacgccccagttgtagctcgccgcgccagctggcgattttgtcgagcatggcattaccgaaacgtagaaagtgctgatagctgttgatttttgctgcctgtggttgttgttggcgcacacgggcgagccagtcttgcgacgctttacgcgcacgagcagcggtgagccagtagacgcccaccaccgggtaaagcagcgcggtaaacgccgttcttcccagcagacgccagaccagcagcatcaggcgcattccccataaccctttaacttcactctgccgcgcccagtggctggaagagtggcacatcagcagtgaaggaatacgcggcaacatgccgaaaaacagacgcgtgtgcatgagcgagatgcggacgttatctttcagggcatcaaaatgcgaaagcccgtccagcggataggtgacgcgggtcggcacgaaatagctggtatttccctgccagtagaggcgcaccatcacttcggtgtcgaaatccatccgcttgccgatggtggcgcgttttgccagttgcagcgtcggcgcaaccggataaacgcgaaaaccgcacatgctgtctttcagttgcagggagagcgtttcgatccatacccagacgtgggtgatccagcgcccgtacagccgtgagcggggaatggagtcatcgtaaattggctgaccggagatcagcgccgcagggtgttgttcagcgagtgccagcagtttggggatatcttcaatcgcatgttgaccgtcagcatccacttgcaccgcatggctgaaccctgcgtctgccgctgcctgcaagccacgcatcaccgctgcgcctttacctgcgttttctgccaggcgaattaaggtcacgccaggctgttcgctaaccagattatccagttgctgttgcgtggcggcatcgctgccgtcatccaccacaatacagggcagattaaatggcttaagacgcgccagcacgcccggcatcatcgcgccgtggttgtagcaggggatcaacacgcagggagaaaagtttaccgacataggcggatcttcccgctactggcggtgtggcgggcgtcaccgtcgtgacgctgatagcagaaagtgagtacctgacttgtttcctgccatgttaattgcagggtaacagtcgtctcaggtataagtggcgccagaaatttaacattctggatactacgaaaacgccagcccggagcaagcagcgtggtagcataatgcattacccagtccaactgggccacgcctggtaacagaggctgtacggcaaaatgaccattaaaccagtagagcatcgggtcaaggtatagaacgatttccatctcctgcggttgaaccagatggcgctcaatttcatggcgtatcatgaaataactcctgtaattgcgcatagacacgcttattcatattgtttactggtatttcatcaataatgcgccagtaacgaggtactgcaacaggttcaagccatggtaatagtgctttgcgccaggacaactccagagttttccctccggagcattgccatatttgacgggcctctttatttggtacaaccacgacaccgatagcctggcgaccattgcgtattaatggtattgcagcgacatccataataccgtcaagtgccagaagtcgttgttcgatttcaaccagtgatatccgcttctcctctatttttaccactcgaccacgtcgtccgatcaggtggaactgaccgttttcattgaattgcaacatatcgtcaagcaccaatccttcagcagggattagtggcgaaaagacacgaaccccctcactttcctgtgaaagatgaacatcagaaaaagtaaaccaggggatattatcctgttgacggtaacgccatgcgagaatacctgtttcggtactaccatagatttcatcgggccatatattcagccaggtggaagttttctctacatcctgccatggtagcataccgccggcagagagaatcatttccactgggggaggcgtcagatgaaggtcgagtcgcttaaggaacgccgggctgctgacaaaggcatagcggtaggtatggcttaatgcggcaagttgctcagaataccagagcattgcggcatgcaatggcaggccaagtgccatgggtaaaaaaatacggaaagtcagcccatacaggtgctgaggcatcacggatgctacaaaacgacagcccagtagtcggtctgcaaagtgagttgccagcatgtttgcttcttgatcaaggctgataagaggttttgcaatttgttttggttgtccggttgaacccgatgtgaaaagttcaataaacgcgtcagaagcaatatcatcaaaggctatcgtgctggtcgtcatctggtgagatgtgcttacaacaaactgtggaccgttccagcccagccttttatcactcaggacgcaatcaaacaaggagcgttgtacatttaacaaagcggcgcgattatggcccgggattaccgggattttacctgagtgtagcgtggccaacaacgctacaataaaaagatagctgttttcaaaacaaagtgcccagcgattgcctggctggtcgcgtaaatggtcgatcaaaagcgctacatcatgccgcagatgccccagtgtccaggtatattccccaagccaggcaacaggagttgttacagggcgagaggctgtcaaccactgtgaaagagagagagtctgattcatggtgttttccgtttgatcatcttacgacgtatcagccattcccctgcagtcaggaaacctatcagaaggtaagcaatgataccgttccaggctgtccacaagggcatgttgccatacaaggtggtaaataacgcaatactgccattgaaaataaaaaacaggcaccagacctgcgttacgcggcgggtatatcgcacggccttttccgggaggtctggctcctgcaaacgtgccagccgctcaactatcggcattgtcgaccgcagcgaaccgccaaaaaccgccagcatgactgcgttaaccactaccgggtaaaacagcagtaactggtacgttttcaacagaaaactggagacacacaatacaatgcccacaacagcaacgatttttgtgacgacctggagcggccccgtctggcgacggggctggcgcaggcgcaataaaagcaacagcgccatcagcggcaacagccagtgcaggctgttatgcaccaaacctagccagattaaaaaaggccagacgagcagcaataatccggtcagcaacttaatcatcggtagcgagcgaatgcccgacatcaaattagccttcttgtagcaggcgttctacagcctcgacaacatcctggactgtacgcactgctttaaactcttccggcttgattttcttaccggttttcttttgcaggtgcacaatcatgtcaacggcgtcgatgctgtccagttccagatcttcgtacagtcgcgcttcaggtttgatgtcctgcggatcgatttcaaacagcttaaccagcagggctgagacttcctgataaatggtttgttggtctgtcatgatggttttcctcaggcacgttgcgcagcaatgaaagaggccagagtggcgacggagaaaaagtgctgacgcatttcttcgctttccgcagagagcacgatgccgtactcattttttactgccagtcccagttccagtgcatcgatagagtccagccctaaaccgtcgccaaacagtggcgcattgatatcaatatcatcaggagtcaagtcgtccagattgagggtgctgatgatgaggtttttaatttccagataaagcgcttgcattatttattcctgatagaggtaaacaaccttgctgtaattgaagcaaaagatgccggtttaactgtcttgcagccagcgtcggctcttgtgaagttgcatcgtaaaatttattgatttctacccgcccatggacttcaaccgtaaaaaacggcctggcaggcgggacgtcataccacttactttgtttatccagcagatgctcgctacagccgatcgtcacgatgcgtaaatcgctggtgcagcgcacggcaatattcgctgcaccgcgctgtaacgtcattttttcaccgggcttcgttcgtgtgccttcggggaaaatcaggatagtgtcaccctgtgccagtcgctgttggcagcggggtaacagggtttctgcttcgctgttgattaaataatctgccgctcgcacgacgccgccaagaaaaggattttttaacagcgcgcttttcaccaggcagtcagtttctggcatgactgatgccagcagcacgtaatcgatcagcgtgggatgattggctacgacgaggcaaccgcgttcctgacgtaaaatttcagcgccatcaatacgataatccagcacgccaagccctttcgcgacagttaaaaacaggcgaaaactggcggcaatgctgcgacgtgccaaacgacggcggcgggaagtatcccacactaaaactaacaatatgttaaaccacacgactgaaagcagcaggccgccgagaccaaacaggacaaaacataacccggtcatgaccagtcgccatgcccatcccaggcgcgacatcagcttactcatctgcggctccagcgccattgcacgcgctcgccaggcagtgaaaaagcatctgcattttgtaaatagtgctgtaaaaacaacatgctttgcggcagtgttgtttcatttaccgcaatggcttgctgcgtttcacattgccagtcatcgccagcttcaatcaccagcgcgacggcgtacggccaggtaggcatttctgcgggcagttgcgggtgataaaactcaggtagaaagccatcaaaatcgaccatcaacacgcgctggtatcccgcttgtagcaggctaagcacttcacacaaaccttgctggaaactgtcgcgaccagccgaaagcgatgacgaaacgatcggctgtttggccacaatggtcaggttacccacggaagagttgtgtacggaaagcgcgaagtccgtcggagaaagcgcctgttcggttgccagtgcatgaacaatgcggtaattgcgctccagttcgccatgacgactggtatacaaaacagcgtctggctgatggcggcgtagcattgtcagaccgcattcaacagccagtttgctgcctgaactgagacgacgagcggtcatcattggcagttcacttaattttgccaacggcgcggcagggtcaatcgcccacggctggcgcgaccatgcttgccattgctgcacatcgctaagtccaggcgccagtgcctgccagttggtaatatttaatgcaaatttcatcaacgcgcgcccgcggtaaaccaaaattattaagtgacgattatttcttttggcatatcaaaagtgtatgcccaacgcctaaattattgtgacgctctgctacctggaatcctgctttattcagatagtcgtaaaatttctctgcactatagaaacggctgttaccgtttgccatgcaggtaaaataaagtgaggatgcattcaggctaaacgatgtcgcttcaaaccgctgtgcatcccagaacaactccatgatgcaaagttttgcgccaggcttcattacgctggcaattttgctgagtatgctaattatttgttcgggtgaaaaacagtctaaaaattggctcatccaccagatatcagcctcgcctggtaatggtgcatcgcttagcatatccaccgcatggaaatctatgcgatcagaaaaacctgcattcgcgatattttctttcgccagtacgatttgttgtggcagatctaataacgtaacggcgatgttttcattgaatttgcagcagcgcaaagcccacttacccgtattgccacccacatcgtacaaggttgtggggttgttggcgaatacataaggcagtgcggcgttaaatgcgccatctgaatagtaatgatcaaacgcaaaccagctatcacgtgcggcgtctggtaattgcgaaagtgccggatatatcgtcggccagtcgccaaatacttttaacccggaaggttttccttcattgagtgaatcggcaaggaagaagagcccctggtaacagacatcctgggtgaaatccatattcacgcgagtcatagtgtcatgcaggaggtaatgaccgattttcgccaggtaataaattccctctttacaggtaataattcgcccgcttaagcccatatccagtaacacacccacggcatattcattcaggactgtgtgctcagtaatcgcattaaggggagctccctgtttaccctgttgatccaaataatctaatattcctgcattgcgcaggcacaaagctgcctggaaaagcataggagcaaaggcaatccgctgtgcttcggtgatggcatccagtgcgctgagcgtgtcctgttcgtacatatataaccattcttatagagaaagttaaatactatcgggccattccagcccgatatcagcatcactataacgttgctcctgtagataagttaacctgtatatctttatccaggttacgcacccagcggttatagtttttatgaatttttccatcagaagcctgcagattcaggctactgtcatatttgatgttatagtaggtagctgtatatgtaatacgaacctctgcaacgtgatttcgtgtttgatagcgagctttaataactccaggggacacttgcgtcataatccacttgcgctgcgcacctgctttcaaaatggcatttttaacctgctcctgagtatgacccacactgacagtggtgcttatctgttgcactggggccgtacggacacaggcactcaacatactgataaaaattgtgatggcaaaccattttatataacgtttcattagtgcctcttatgtatgcaatacaattatataattaaatagtaataacagacagtatatctgtataaatcccagacttcttacccgaaatatatttggggttatattggattgtcaatgtctggttgtgacagggaccaaagatatgccggtatcatttttgtaaatggcttgtgaggtggagagccctctgcggtaagctccctcgacattccttttttatttatccgcagatattcttattctgatattgataaaacacggggtatggattgagactgaacagcttgttgtgcccggttttaatggtaaatgcatatgtgtcccagaattgatattgacttcctggtactcaatattctgaaaagctgaagaaagatcacgtttttgacatttttttgatgtcttgtcataaaactgtttcatgacagactttttcaggtgtaaattttctcgctgacactttttgacatgaatttacactggcatcacacaggccagaatacggggagaacatgcagcgccggcagaacaacattctgacgaaaacgtcccttttatcccgtgcgttgtctgtcccctgttgtgatatgttccggcgcggctctccgtggatatgctatctctccctctccgttttttctggtttttttatccccgcattttcgtctccggcagccatgctgtctccgggtggccggtaccctgctgaacagtgcgctgatttatgcggggaataacctgaagctgtttacagaccgtctgcataaccagcatggtgatatcctggccgacaacagtctgtgggtacagaaggacagcagcgggacggcaaacagcgaaatcattaaccgttccggtaatattgaaaccatgcgtggcgatatcaccatgaatacggcgcatctgctgaattcatgggatgccatttcggccagccatgaggtcattccgggcagcagccgcggggtgatttcaccggttccggaaaataaccggtggtggggtgttgtccggcatgatggtgtggaatatctggccgtgtactggggtaagggtgccacggtacctgatgaataccgtatccgtacgggagatacggatacggtgacagtcagtgccaccggccatgctgccaggatatccggcggcgctgatatgcatatccgtgcaggacgactggataatgaggcatcgtttattctcgccggtggcagtatgaccctgagtggcgacacactgaacaatcagggctggcaggaggggaccaccggaaaggaaacggtctggcggcttgcctccgactcactccccaaagcgtggtttactgagccatggtacagggtctatcgccaggtctcgccggatgcgacagaagccagtggcacctctccggtaggtcagtaccgtgcggttatcagcgctgccggtgatgtgtctgccagctttgccactgacaccggtaataccactgtcatgccccgggcaggtggttcaggtaacacgataacggtgccttcgctgaactccctgacaccaccgacggtcagtcagggggtgagcggtgaagccctgctgaatgaaagcggtaccgggataaccggccctgtatggaatgacgcgctgccggatacgctgaaggatatcccgggtgcgctgtcgctgtacggggcaagtgtaagcagctatcccctgccatccggtaacaatggttattttgtcccgtccacggacccggacagtccgtatctgattacggtgaacccgaaactggatggtttcggaaaggtggacagcagtctgtttgccggactttatgacctgctcaggatgcaacccggagaggcaccacgtgaaacagacccggtgtatatcgatgaaaaacagtttctgggctcatcgtacattcttgaccgtcttggcctgaaaccggaaaaagattaccgctttctgggggatgcggcttttgatacccggtatgtcagtaacgtcatactgaaccagacgggctcacgttatatcaacggcacaggctctgacctgacgcagatgaaatacctgatggacagcgcggcagcacaacagaaagcgctcggactgacctttggtgtgtcgctgaccgccgggcaggttgcacaactgaccagaagcatactgtggtgggagtccgtcaccatcaacggacagacagtcatggttccgaaactgtatctgtctccggaagatatcacccttcataatggcagcgttatcagcgggaacaacgtgcagcttgcgggtggcaatattaccaacagcggcggcagcatcaacgcacagaatgacctcctgctcgacagcacaggtagtatcgacaacctgaatgccggactgataaacgccggtggtgcactgaacctgaaggccatcggggatatcagcaatatcagctcagtcatcagcggtaaaaccgtatccctggaaagcgccaccggaaacatcagtaacctaacccggacagaacagtgggcgatgaacaacggatataaccatttcagcggaacggataccggtccgctggctgctgtcagggcaacggactcactgtttatgggcgcagccggggatatcagtatcaccggtgccgccgtttctgccggtgacagcgtgttactgtccgccggtaatgacctgaacatgaacgcgatacaggccggagaacgtcgtcgctatggcgggtccgggtggtatgaaactcatgccgtggcccccacggtcactgccgggaacagtctgatgctttccgccggtcgtgatgtgaacagccaggctgccggtattacggctgaaaacagtatggatatccgcgccggacgggatgtgaacatggctgcggagtccacaggcgcaggtgaccacgacagcactttcagcatgaagacggttcatgattcggtccggcagcagggaacagacatgaccagtggcggtgacatcacggttactgccggacgggatatcacctcagttgcgactgctgtaacggcaaagggcgatatccgtgtgaatgccggtcatgacatcgtactgggtactgccacggaaagtgattatcactacagtgaatcaggggaaacccgcaaccgtctcctcagccatcagaccacccggaccatcacggaagacagcgtcacccgtgagaagggctctctgctgtcggggaatcgcgtgaccgttaacgccggcgataacctgacggtagagggttcggatgtggtggctgagccgggatgtgtcactggcggcgggtaatcatgttgatgttcttgctgccaccagtacagatacgtcctggcgctttaaggaaacgaagaaatccggtctgacgggtaccggcggtattggtttcaccattggcagcagtaagacatcgcacgaccgccgcgaagccgggacaacgcagagtcagagtgccagtaccatcggctccactgccggtaatgtcagtattaccgcgggcaaacaggctcatatcagcggttcggatgtgattgcgaaccgggatatcagcattaccggtgacagtgtggtggttgacccggggcatgaccgtcgtactgtggacgaaaaatttgagcagaagaaaagcgggctgacggttgccctttccggcacggtgggcagtgccatcaataatgcggttaccagtgcacaggagacgaaggagagcagtgacagccgtctgaaagccctgcaggccacaaagacagcgctgtctggtgtgcaggccggacaggctgcgacaatggcctccgcaaccggtgacccgaatgcgacgggagtcagcctgtcgctcaccacccagaaatcgaaatcacaacaacattctgaaagtgacacagtatccggcagtacgctgaatgccgggaataatctgtctgttgtcgcaaccggcaaaaacaggggcgataaccgcggagatattgtgattgcaggaagccagcttaaggccggtggtaacacaagcctggatgccgcgaatgatattctgttgagtggcgccgcaaacacacaaaaaacaacgggcaggaacagcagcagtggcggtggcgtgggtgtcagtatcggtgcaggtaaaggtgccggtatcagcgcctttgccagcgttaatgcggcaaaaggcagggagaaaggtaacggtactgagtggactgaaaccacaacagacagcggtaaaaccgtcaccatcaacagtggtcgggatacggtactgaacggtgctcaggtcaacggcaacaggattatcgccgatgtgggccacgacctgctgataagcagccagcaggacaccagtaagtacgacagtaaacagaccagcgtggctgccggcggcagttttacctttggctccatgaccggctcaggttacatcgctgcctcccgggataagatgaagagccgctttgactccgttgctgaacaaaccggaatgtttgccggtgatggtggcttcgacatcacagtgggtaaacatacccaactggatggtgcggtgattgcctccactgccacaccggataaaaaccacctggataccggaacgctgggtttcagtgaccttcacaacgaagcggattataaagtcagtcacagtggaatcagtctgagcggtggtggcagcttcggggataaatttcagggtaacatgccgggtggcatgatatccgccggaggtcacagcggacatgcggaaggaacgactcaggccgcagtggcagatggcacaatcaccatccgggacagggacaatcagaagcagaatctggcgaacctgagccgtgaccctgcgcacgctaatgacagtatcagcccgatatttgacaaggagaaggagcagaggcgtctgcagacagtggggcttatcagtgacataggcagtcaggtggcggatattgcgcgtacacagggagaactgaatgcgttgaaggccgcgaaggaagcaaccagcgaaacacttcctgctaatgcaacagagaaacaacgccaggaatatcttgcgaaactgcgtgacacgcaggcttacaggaatgaaatggcgaagtatggtaccggcagtgaaattcagcggggtatccaggccgcgacagcggcgcttcaggggctggcggggggtaatttagcaggtgctctggccggagcttcagcaccggaactggcacatctgctgaaatcaacagaaaaagacccggcagtaaacgccattgctcacgccattctgggcggcgcagtggcggcaatgcagggtaataatgccgctgccggtgcagcaggcgcagcaacgggagagctggcagccagagcgattgccggaatgctgtatcctggcgtgaagcagtcagacctcagtgaagagcagaagcagacgataagtacgctggcaaccgtgtcagcagggctggccggcggtctaaccggaaacagcaccgcatcagcagcagtgggagcacagagcgggaagaatgctgttgagaataactcactcagtgctggctggaacaatatcctgccatcaggaacacaggattacggacaggccgtagcctcgtggaatcagtatgctcaggacaataatctgacaccggagcaggttcaagaagggatgaatcgtatagctattggtgaagggccttcttgggggacaacatataaagtacacccggtagttcaggctggcggtgatgttagctttatccggggttatactttaagcggaactatagatgacaatcatatttcagctaatcaaggggatatttatagtataggtgctcatggcggagcctcgatcggattatcctttggcccgtatttcccgggattaataaattcaaatgataacgattattcgataaatggtggttttggcgttggtgcagtggggctttctacgggtaaagatggtgttagtttcacttttggttttggcccaagttggggttggagtgcaactgaaattaaaggcgttgacgttaatggcacttcaacaagtgaggtttatcgatatgattttaaataatttctatagtttactatttttattgatgcttgcgctgtcaatattttccttcacagtgctatttgctttgtttatatataaagatctcggtggtgtaaaatttgcccgggactcttttttgttttttgattatatattttttagttctgacatgagagcaaatgcctctgcactatcggttatctgtgtttttatatttggattggcttttgatcataatcgtaatccacttgttaagaattacttgatcgatatagtatggtttttaggtgttgttttattttttatacactgtcgttttttttctaatctggaatatggtaagacaaaaattatttttgtaagagagctttttttcaacctaaaaataaaactaaggttaatatttttatggttgtcacgattattattcatcatattgatattaaatcgtttttatcgttgatttgttgttgagaataatttacttggcggtagtgaatatgctcattctgcgtggatacgccagcatggtatcgacatggcgacatgtacagaaaactcttccggtgccgcctgccagaaagcaatgaatgagagggatgctgtagggctggctctggcaacaggtactgtggcactactccccggtagtgctcaggctatgtggggacttggagcaagtgcgaatgctggtatcagttatctggctgatggtactgtagatccggcaaacgcagccattgcaggctgggtgaatgtgttcagcatgggtaatggcctagcggggactgtgggctggaatgctgcaggtggtgcgctgggtaactggatcggcaacaaagatcctctgtctggtgcaatttcaaatggtatcggttctgctgccgggtatggtatcggtaaaggtattacttaggggacagataagattacgaatgctgtaggaaaatgggtgacaaatggctgggatcctaagtacgatccaacatggataaaatatgctgaagtaaatcgtaacgatatcattcgagaaggcatgaaaccgagcaatattcctggaactgctggagatattggcggttctataggatccgagctaggtggaaaagtaacagataaagtatctgaggaactcaagaaatgaaatattcttttcgagtggtaataggtaagtttattatatgcagttcaattctcttattgtgttttattggcatgatcttagcggccataataactaaactaacgtttgtagcgttagcatggtttcaaagcgggatttttgaagttttgtagagcgatattgtttatgctgctcagttgggtggtctgggggggggcatattaggtttttgttgggttttgttatatctttttagggcaaagggctttagttgagaataactacctgagcgtgtctgaaaagacagaacttgagatagcaaaacagacgcttaaaaacagtaaagatccggcagaacgtgaaaaggtacagcagaaatatgatgcattgcttgaaaaagatattgccagtgataaggaggttattgctgcctgcagtaatggtaatgcgggtagttcagcgtgtgctagcgcaaggctgaaagttattgcgtcgaaagaagggtacgaagatggcccttataactcgaaatacagccagcaatacgctgatgcgtatggccttctgccagcgctcgtttttccagagcgtgccattcagctccaactcgtgtcaggcgtagtttacgcaggctgcgttcaaggtgatggatattgctcactgcgaacctcccttgccacgcagtagttgctcataactgctcaggttatgctgtatcacattgactactggcaacgccttttcctttatacccaggaagcgcatcagccggtgcagatccacgtttcccgggggattcaacatctgctccataccttttgccacgactgagatatcgtcgtatcctgcagccagtttcagggcatgtaccatcagccttcctgccatgtcggactccagatgattacataagcgacgccacagcctccgcaattcatcgtctggcaggatgtcatttctcagcgttgcatggcagaacgcaccgggcttttttgccagactgtcgatcacatgtcggaagtcgatacgacgggcccgcgtcttccctttttctggtctgacacgagggcagctcatgacctcgctgctgccaacgtaacggctcagacgatcgtcccataaccggacccgtaacagttgacctacaagccgggaaggtacgctgtagacgatgtgcttcacattgatggtactgctgcggctaaccctcacagtcagcactgcgacgaagcggcagcggtttcagatgaagacgttcttccttgatcagatcatgattgttacggttgtgccgcataacctgctgagtgatgaaggcctgatattcttctatggtgctgaagtcgttactgccccgcagtatcagcgcctgacagatacgccttttcagatgcccgtgggcactttcaaccgagccattttcgtggccccgaccggaattattatgtacgccctgcattccgtagtgctgacagatagcagtataacgctcagtcagctcgcggcgtccatctccgcccagttgtccgagggcttcctgcagaccttcagccagagcagagaagctcttaccacccagcacaacccgcatccagctccagtggctccattccagacggaagtgatacaacttaccgacgatggtgacaactacacctttcagttcagtaaagtccgacaggcctcgcagaccgggctgatgtcgctggcggaacatgacctcctgctctgcactatactgtagcttccattcgcgaacccgccgttgcattgttcttcgaaggctgttgggatactggccgggatatttatcctgtagcatctccagcagagttgttggtgtcagagccggcctctctttcaacagaggaacaagcatgctgtcccacatagcttccagaggaagctttgcgtgtgcgccagtgccgaacactgttgttttcccactctcctttttcgatccgacgaccagaatggactgagataccagccttcatggccgagatatgcggtcggtcaggtggtatttgaaaccagactgaagcccacggtcgtcatcgggacgcaggccgccgccgtgcatggtatcagtgagcaggcactctgcggagcaccatcatggactgatgtggtgcggcaactgcgtcatgcaatcggggaccgaccagtaattatctttaatgcccggttcgacatccgcattctgaaaaagactgctgccgcacatagcgatccggctgactggctggaagaactgacggtatattgtgtgatggagctggctgcaggatattatggagcctccaaccgctatggcactatttcactggcctgtgctgccagccagaccggactgaactgggaagggcaggcacactcagcgatcgctgacgcacggatgacggcaggggtggtaaacgctattgctgcatatcatctggaactgctgcaggaacaggcacggctgaaaacctgactgcctggcctgtataccgcaatcatttacgttatccagacgtaaatatatcaataaatagcaatcccccagatacctaatgtagttccagcaagcacggccgggcagcttgttctgcctgcgttttcttcaattgagcagtagaccatttagctgtggcatgaatggctgcagaactttcactgttgctacctccagttccaccaccgctgccagagccactcccgtctggattatcattcaaaagagtaatgattacctgccccttatcatcataaggaacaccatctttatagtacgctacagctgtttccattataaaatcctctttgacattaaaaacaatcagttaaaaataagtactgcatatataattactggttttatatacagcataaaaattacgccgctgcgttttccctgtcaaccctgtggattttcatttttgtgaaaacgatcaaaaaacaactactcacaattcgacagtcccgccagataccgcaaaaccggccagacgttaccgttttccgggaccatgatatgagccccgttggggagggtatggagttgctgaaaatgacggtcagattgagttcaccgttttattgttacaggaggccagggcttgtctgctaccggtccggacgagagggataccgggaatttgaatccggttaactgagccggacatacggtaaataaggaatgcaggcagaacgggagtcactgcaggatgagaccggcactacagcagaaaaacaggtgattctggtacggctcagccactaaacacagttggaaactgatgataagatagtcagcggttatataactcactgagtaaaaagatataaaggtaaggagacactcatgagtcgttccggtagcacactgtatcttatcgccctgctgacagcggcaacggtcctgacagcctgcacgccaaagggcagtatggaacaacatacccggcattacgtttatgcatcagatgacggttttgatcctaacttttccacccagaaggccgacacaacacgaatgatggtgctttttttcggcagttctgggatatgggagctaaagataaagcgacaggaaaatcatggagtgatgtgcaacaacgccttcagcagtttcacagccaggaatttttaaactcactccggggcacaactcaatttgcgggtaccgattaccgcagcaaagaccttaccccaaaaaaatccaggctgctggctgacaccatttcagcggtttatctcgatggttatgagagctgacagtgacggggaacgttgcgggggaataaagatattgggggtaggctgagccccagaatatggtacctccctgcccctccaatattcggtgatggccggacaaggagtccaggagagggggattagtggtggatctgcgccaggtcgtcttcagtctttatgacgctattacggtcaatgccgttctgcagcatggtacgggtaattttcagagtggcttggagctcactttctgaacgacttattagcgtgtgctccggtgatttgcacatgcgcaaatctttcagcccaaaggaggctaatcatcacggcgattacgttcaaatcccccgcgccctcttgctgccaattcagcattgagtaccacgtaacgctcccagcgttcacgcaactgtgcgagctttagcggtaattctttggtgacaaaggcttcctgtatttcaaagtcatcaagatgcccttgcagatatgcatgtacgccttccaacacatcagtcagagtgatgttgttactttgttgcctttcaacaagcggcccctgccagctatgccagaaggcctgatggcgcagacagctttcgtcattcgcgagcaaccacaaatccataaagattcctcgtgcaactttgaacggctatttgtcaacgacggatgaaaagtggctcttccgcaacttgggtggagattttcatgccagtggactcatgaccctctgcctgagtagttcaaatccggctctaccatacatctggcgttttagcatcttcaggcgatttacatgaccttcgacaacaccattactccagcggctactgattgcctcacatatagctgcagcatcagcttccatccccgccgccacgcgccgaaattctgctgaaccgctttcgtggactcgagtgaaccagctacttagctgtgatttattttgggttttcagaatacggtagaactcgagtgccagttgctgcgctattttcagctccggttctttttcacacatcagactaataaatcgggaagcataattttcttcatccctgattattctccagggcatcaaccagcgccttacccgggacattgaaggaagtctgacggcagtagtaaccggtgggttccagcctttacgccatttggcaatagcatccctgacaatggtttcactgcctgtaaacccccggaccaccatttcccgccattatccggctggcgttataattcccactttctcgttgctcttttaaccactccctccatgggtccagaagccctcgctttggaggtcgggttgacatttcagggaatgttcctgaacgtacccagcgactgactgtcacacgcgacaggcctgtaatacgggatatttccctgaaactacatcccttgttatgcagggccataacctctgtccaacgctgatgccgttttttgcggggttgctgttttaggtgttccggacgacggagcgatgctgcaggcacagatggttctggatcaggtgatttctttggtgacaactcactggcaacaagacgtatcagaggcatatgtcggtacatcattcgttcaggcgcatcgccaatattttttagcaggtgccatcgatcggccacctgtctggcctgaggtgcaccttcacgtgctgctgttgcatagactccactgcgatcacgcgagacaacctgtatttccggatattttctgaaccaggtcgccagcgtacgctgatcacggccgggaagcaggacgaggggacggtgagtatcaagattgacgattaacgtactgtaacggtggccccgatgccacgcccactcatcaataccgacatgaggcgcgcctgactgtttcgtctccggggtattgataaccctgcgaagaagagtatcagcactgcaacggagacccactgccgttgcaacccgtttcccggcctcacctccggctattaatcccagttgacgttgtaaattttgtaacgcctgtgaagactgctggtgtgaaccggcgaagggagcaagcgacccggcaaaaattttacgtgaacaagccgggttacggcagtaccagtggcggacggaaaatacaagccatagcgtatgcccttagcagggtagatgctgtatccggcgccgacgacaactatgaacagagtcgctacgcttaaagcattcaggacattgtgcagtttttcgttttccgtggagatggagggttataccgtcagagctaataatttgtcgactgcatcgccatccgcaaggtaactgtagaagtgtcttaagagagtgcattgagttgcccaaaacttaaaacagcttagatctttgttcaccagaaagtttcatccattttcttccactcaggttgcagaagaaccacttttgcaccgttcgtgacattaatctttaaaacggcaaggtcaatacccagttgttccgccactattgtgataacagccttcggggggagcttttctgtacgcagtgtgcgaccgagagcacggacaagtgcaagctgaatggcaaaaccaagacggttatgagaccgccgctgagctctggcaaatgcaatattttcgcaggagagtgctcatcggggaattaaagttcaggtaatccaaaaagcgtatcgtgcgagtttgtcacgcaagaaatcacagatttatagattcaattttcttcaactgtaggaccttacggaaaacaagtgatttcaaggtgaaaaggcttaacgtgagttatcgcagaaatggttacggaacatcctgtattgtcaaacatgcattaaatgattatcattatcaattagtgtgtgcaatagatggttaagaatagaactttcaggagatacaatgcagtcagtcagtaaatcaatctaccgagggaagttgcttagcagtttacctgctgtgggcgagattcataaagaaatcgcagtatcagaagaaaccgtaacatggatctctctgcaacgagagattatagcgaatattttgctgggaaaagatcctcgcttgcttgtgattgttggtccatgctcaatccatgacgttcaggctgccgttgaatatgcgaaacgattgtccgtattacagaataagtacttatcgcaaatgtacattgtaatgcgcacttattttgagaaacctcgaactcgtaaaggctggaaaggaataatgcacgatcctgatctaaatggaagctataatgttgagaaagggatacgatatgctcgccagtgtttgtcctcaatcacaacaatgcgtgtcgcaaccgctacagaattcctcgatcctttccttactccctatattgctgatttaatatgttggggggctgttggtgccagaactactgaatcacaaacgcatcgtcaacttgcgtctggtttacattgtcctgttggatttaaaaacagcactgatggaaatattaacttagctattgatgctattcttgcagcccgtgaacaacatgttgtatatatgacatctttaacaaaatgtatatctaccctattaaccgatggcaatccacatggacatctcatattacgtggtggtagagagccgaactatggtttgtcggatataacgaaggcagtgaaattaatgcatgatgaaggtatcaatcatcgtctgataattgactgtagccatggtaatagtggtaaagtggctgaacggcaaatctctgttgctcgtgaagtcattgataatcggaaaaagatgccgggatatgtagctggaattatgctggaaagctttttacaaggtggaaaacaatcagacagccttccgcgagagtatggtcagtctgttactgatgagtgtctttcatggcaacagacagaacaattattatcaactctggcagcacaactttaatttcaactattcagtatcattttttaagggaaaaatgaaattatttatcttaatacacccaatctgggcatcaaagaaacagatgttttatctgtacagttcattgttggaagggaaataaaatatgacatgaatggcagaagtgttatcactctgacattaatatttttattaggagttgcagtatttctaatataccatctccaatggatgtatcttccagggtattatctgtggggcctatgtgtatgtatattgtcaaaccagttagctcttatgcttcatttcctagcccttcttggcaaatgatactgtacttgcgtaggtgtcatctgtgacatggttgcggtgctattttgtctctgttggcttaaaaagagtaattaagactatgataaaaagttaatttccaaagaacacgatagggcgctaatcaataatcggatgcatgctaaatcatattttataatatgtctgtggagatgatgctaaagtcatcaatagttcttgaggaattcattatgactatcattggtatcgttcttgccagaaacgtcttcgctgttcacaatgttgcgttaaatgagaaaatgttctggtaaacccccggagagcacatgcagtgctgccagccctgattgtacttttacctccctgagttatgggtaccttgctaagggagtattcaccagtgaacaacataatacaaagtagcgtaaaccttttgttcaaggtcagtcagggtatctcatcggaatggtgtgcaatttaacatcgctgcccagcatgagttgataggcgtgaccgtgatccgtaccgtgggatgtgagtttcatacaggtaatatgatcctacccacgtaatgtggacacggtcctaagcgagattatggttttcaaattgttccgggctgagaccgccacaggcactgtgacgacgccagcgattgtaatcacactcgatataattaaacaccgttgcccgcattatttcccggctgctaaagcgttccccgtggatatattccaccttcagcgaatgaaagaagctttccacacaggcattgtcataacagtagcctttcgcactcatactgccacgcaggttgtgtcgcttcagcagcgcctgataatcccctgaacagtattgaccaccacggtccgtatgaacaatgacgctttccgggcgtcttctccgccacaacgccatttgcagtgcatcacaggccagttgtgctgtcattcgcagtgacatcgaccagccaatgacggcgcgtgaccacaggtcgatgactactgcgagatacaaccagccctcatcggtacgcaagtacgtgatgtcacccgcccacttctggttcgggccgctggcgctgaagtcctgctccagcagattctccaatacgggcaggccatgtgcacggtagctgaccgggctgaacttccggctggctttcgcccgcagcccctgacgacgcaggctggcggcaatggttttaatattgaactccggcatttcgtcagcaaggcggggagcaccgtatcgctgctttgcctcaaagaatgccttatggacagcggcatcgcaggtgagccgaaactgttggcgcaggctcatctggtgacgacgccagagccagacataccagccgctgcgggcaacccgaagtacacgacacatcgctttgatgctgaactctgcccgatgattttcgatgaagacatacttcatttcaggcgcttcgcgaagttgtcgcggccttttggaggatggccagttcctcagcctgctccgccagttgtcatttaaggcggacattttcagcggccagttcgctttcgcgctctgacgaactcatttgttgctgctgtttactgcgccaggcataaagctgagattcatacaggctgagttcacgggctgcggcggccacaccgatgcgttcagcgagtttcagggcttcgttacgaaattcaggcgtatgttgtttacggggcttcttgctgattgatactggttttgtcatgagtcacctctggttgagagtttactcacttagtcctgtgtctactattggtgggtaagatcaaaacccattcatacctatagaaaaataggttgttttttctaacgattgttgaaggggaggtggatctgatgaaaatgcagcggatgttaatattaacatcatacttattataatctttttcgtaagatacatactttcccctttggttttccatcgataaatgttcagataaacaatatatgttttttcttgttaatgtttatatcgatggttttataacatgaaatattcagcataataatcaacaggcttgtacctgatcaggtatcagtttgcaaaaatgtttgttataggtcatgaccgcaaccaggacacataatttcaccacaaccacaaatataatcggcatcatagtcatgtgttactataccggaagccgacttattatttgtgatacagtgtgtctcctgctctacggaggattctacctctataggaaaattatcgtgttttcgtcttgaattgtcttgcttgttgcctttatcaaaggtaacaatgaattcttcatttctgtgattattatcacaattcattcttatgcctcctcacatttcccgatgtatgaccgtcagtgctattagtgtgcgttcaagtctcaggttatacatgagcgacaaccatgagatcctgactaacaattgcatcagtgacataacgtaaaatacctcttgactttatatggacaatatgacactttttttgaaaagtaaataacaatcattctcttttgtctttgtctgggtgaggtcaggtaagatggaatttgctacaaacagagtttctgtaaatgacagtcggtcagcactgtcatcaactttgctgttatctttgatcatgagcgccactctactggaatattctttatcgatgacctgactctcctgactgaggtgctaagatttggtaacttttcataatgaaaataaagcaacaggtaggtattaatgagttataaaaaactgtcccaattgacggctatattcagtttacctattactatcttattggtttcactttcatcccttcggattgttggcgaagggaattcttatgttgacgtttttctaagctttataatatttcttggttttattgagctgattcatgggattcgaaggattctggtctggtcaggctggaaaaacggaagttaaatatgatggagtttatatgcgagaaataacagaatcacagttaagatatatttccggggcgggaggtgcgccagcgacttcagctaatgctgcaggtgctgcagctattgttggagctctcgccggaatacctggtggtccacttggggttgtagttggagccgtatctgccggtttgacaacagcaattggctcgaccgtgggaagtggtagtgccagttcttctgctggtggcggtagctaattatatttttatttattttacaggtactttttcggtagtacctgtaaaatatatcctttttgtttaaaacagatagaagatccatttataagtgtgtttttatgttcaacactttactgatgaagatatgatttacagtcgttgataaataattttttaatttatgtgtaattaatagagttttattgtaataaggaagaagctgtcaggacacttacttgctcttttatgaacactcttttatgaaaattgaaacggagaatactgccagatgagtcatcagtgttcactttctgaactgaatgaaaacctggtgcctttcactgccaggcagatcaagtcctcattaatctggtgtgcagaggatgtcagaaatccagacgagctgcaaaatgcctgcagttatattatcgatcctggcagtacagcttctgccaaagtgttccatgcagagcgctatggtggcagtggtattcagcgtaatggaggtggtgcacgttgtgggtttgatggtaactaccaggttaaaggaataggaagtaatccgttggttggcgaaggtactgacgaacgtcattctaatggtgcactcggcgctgttcatgcaatatatgaggctttgtggggagaagtactggctcaaatattaccttatagtgctgtgcgggttcgggcggttttacttacagatctctatactgaaaaggcatttgagcgctccggtaggaaatcacgaagagccctgttggtacgtgagcctgttgttcgcccggcgcattttgaacgggcaccttacttccaagtaaaaccggagtattccagtctgttaattcacgatgcctgtcgggttagatctgtgatccacaagctgccaggatatctacctgtaccaccggaagaaattgatgctgaagcacgaactgatccccggatttattgcattgaggggttatgtgaactggcacgtcgtgaggcctggcaaatggcattttgtcgaacacgtttcctgagattgacaacttctccttctaatattgcaatggatggcagattaatggattttaacggactcagttgtctgtttccgggagattccccagctgattttgggtataaactaagattagctgaactggcaaaagaaccgatggtacttatgcaagggctgtctgatctctgcttgtatatcggaaaatatatgtttgaccctgacttcactcttgcagcccgtttgaaggttgaggagatatttcagaaaacttttcatgaagcatgttattactgttatctagaactgttgggtattcctggagaatttataacacaaaaagagatacctgatatattgaaagaactggttaacagttttgttgcattactcaataaatactacgagaaatcacatgcccaagatattgtcaatcaggatggttcaccattgcaaaagttggttgtgacgctaatccatcataggcataatcaaaagcaggcactgaatagtagcatcaagaatgatgtttatttcaccgttgcacaacagtgtttttcccaggccatccactggctgacgcaaggcagtaccagacgtcagataaatgcctcattactcctgaaagaaattgaacatcataccatgaaaaggctgcaacccagggaagagctgaggaaagagaatatgtgcgaaaaaattgccatcctgctggataatcatggcgatgatcccctttttttacaagaagcaatttctgatatgaaaaattttatgcttaagttttccagagatgcatttggatatcttgaaccgataagaaacacagtgtaataaatatataagggaaatagtaatcatgtcttatataagggaaaccatcagaggaaaagatgaatggactgtttatgaacagatcggttttgcggtcagttgtatgctctacaatcgtaattacagtctgtatccggtgttaaccattcaatactggactgaatatgcgatacagcataatcagattaaattcctgtttgattcacgaggttttccactggcgtatattacctgggcatatcttgaggctgatacagaagcacgcctgctcagggatccagaattcaggttgcatccgtctgaatggaatgaagatggaaggatctggattctggatttctgttgtaaaccaggctttggtcgaaaagttattgactatctcatacagcttcagccatggggagaaggagaagtacgatggttaagcaggcgaaagaaaattgtgacatacatccctgagcggctgcataaaacgtagtacctctgaagatacagagataattgtaaattacggggtaaatgcatcgctgatactattttgacaggactctgtattttctggctttgattatagcatttcggttaaccagtgaaggtattacaggaaaagtgtgagtaagaggagctattttgtttcgtcaggatgctttagaaaacagaaaaatgaagtggcagggacgggcaatattacttcccggaataccactatggttaatcatgctgggaagcatagtgtttattacggcatttctgatgttcattattgttggtacctatagccgccgtgttaatgtcagtggtgaggtcacaacctggccaagagctgtcaatatatattcaggtgtacagggatttgttgtcaggcagtttgttcatgaaggacagttgataaaaaaaggggatcctgtttatctgattgacatcagtaaaagtacacgtagtggtattgtcactgataatcatcgtcgggatatagaaaaccagctggttcgtgtggacaagattatttcccgtctggaagaaagtaaaaaaataacgctggataccctggaaaaacaacgcctgcaatacacagatgcgtttcgtcgctcatcagatattatacagcgtgcagaggaagggataaaaataatgaaaaacaacatggagaattacagaaactatcagacaaaagggctgattaataaagatcagttaactaaccaggtggcattatattatcagcaacaaaacaatcttcttagcctgagcggacagaacgaacagaatgccctgcagataaccactctggagagtcagattcagactcaggcagcagattttgataaccgtatctaccagatggaactgcaacggtacgagttacagaaagaactggttaacactgatgtggagggcgaaatcattatccgggcgttgactgacgggaaagttgactccctgagtgtcactgtcgggcaaatggtcaatcccggagacaaccttctgcaggttattcctgagaacattgaaaattattatcttattctctgggtcccgaatgatgctgttccttatatttcggctggtgacaaagtgaatattcgttatgaagcctttccggcagaaaaatttgggcagttttctgctacggttaaaactatatccaggactcctgcatcaacacaggaaatgttgacctataagggagcaccacagaatacgccgggcgcctctgttccctggtataaagtcattgcgatgcctgaaaagcagattatcagatatgacgaaaaaaacctccctctggaaaatggaatgaaagccgaaagtacactatttctggaaaaaaggcgtatttaccagtggatgctttctcctttctatgacatgaaacacagtgcaacaggaccgctcaatgactaacgggaatttcagacaaattataaatcagcttgatatgcgctggcgacgtcgtgttccggttattcatcagacggagaccgctgaatgtggactggcctgcctggcaatgatatgcggtcattttggtaagaatattgacctgatatctcttcgtcgtaagtttaatctctcggcccgtggagcaaaccttgcaggaatcaatggaatagcggagcagctggggatgatcacccgggctctttcactggagctggatgaacttggtgccctcaaaatgccgtgtattctccactgggatttcagtcacttcgtcgtgctggtcagcgtaaagcgtaaccgttatgtactgcatgatccggccagaggaagaagatatctcggtcgggaggaaatgagccggtattttacgggcattgcacttgaggtctggcccggaggtgaattccggacggaaacccagcaaacccgcataagtctccgttcactgattaacagtatttacggtattaaaagaacactggcgaaaattttctgtctgtcagctgtaattgaagcaatcaatctggtaatgccggtgggaactcagctggttatggatcatgcgattccggcgggggaccgagggctgctgacgcttatttctgctggcctgatgttctttatattgctcagggccgcggtgagtatgctgcgtgcatggtcctcactggttatgagcacgctcatcaatatacagtggcagtcgggtctgtttaaccaccttctcagactgccgctggcattttttgaacgccgtaaattaggtgatatccagtcgcgttttggctcccttgacactttgagggccacctttaccacctgtgtggttggggcaatcatggacagtattatggttgtgggtgtttttgtgatgatgctgttatatggaggatatcttacctggatagttctcggttttaccatggtttacgttcttattcgtctggtgacatacggctattaccggcaaatatcggaagaaactcttgtcaggggggcccgggccagctcctattttatggaaagcctgtatggtattgccacggtaaaaatccagggtatggtcgggatccggggaacacactggcttaacctgaaaatagatgcgatcaattcaggtattaagttaaccaggatggatttgctcttcgggggaataaatacttttgttgccgcctgtgatcaggtggcgattttatggctgggtgcaagccttgtgatcgataatcagatgacaatagggatgtttgtggcatttggttcttttcgtgggcagttttcggatcgggttgcttcgctgaccagttttcttcttcaactgagaataatgagtctgcataatgagcgcattgcagatattgcactacatgaaaaggaagaaaagaaaccggaaattgaaatcgttgctgacatgagcccggtttcactggaaaccactgatttaagctaccggtatgacagccagtcagcacaggtattcagtggtctgaatttgtctgtggctccgggagaaagtgtggctataactggtgcctccggtgccggaaaaaccacattaatgaaagtattatgtggactgtttgaaccagatagtggaaaagtactggttaatggcacggatatacgtcaacttggaataaataattatcaccgtatgatagcctgtgttatgcaggacgaccggctattttcaggatcaattcgtgaaaatatctgtgggtttgcagaagaaacagacgacgaatggatgacagaatgtgccagagcaagtcatattcatgatgtgataatgaaaatgccaatggggtatgaaacgttaataggtgaactgggggaaggtctttccggcggtcaaaaacagcgtatattcattgcccgagctttataccggaaacctggaatattatttatggatgaggctacaagttctcttgatacagaaagtgaacgtttcgttaatgctgccataaaaaaaatgaatatcacccgggtgattattgcacacagagaaactacgttgagaactgttgacaggattatttctatttaaaatccactggtgtaactttgtaaggagttttgtcgatgggggaggtcaagaaggatataaaaataacagtgattgcttttgttatcaattatctgttcttttatattccggtgtcattatatcttagttattactatggatataatttttttaatctatatatgttttttttatcacttgtagttacatttttatcgttgtggttaaacgtgaatttttacttcttcacaaatcttatagcgaaggtgttgaaatgagaaaactatctgaaaatgaaataaaacaaatatctggaggtgacgggaatgacgggcaggcagaattaattgctattggttcacttgctggtacgtttattagcccgggatttggttctattgcaggggcttatataggtgataaagtacattcatgggcaacgactgcgacggttagtccctccatgtctccctcaggtataggattatcatcccagtttggatccggcagaggtacatcaagtgcctcttcgtctgcggggagtggaagttaaaccttatattgttaatgaagcacctgttacaggtgcttcattatatgataatggtgcctatgtaacgctttaagttaggctcctccgaacgtttattattttatgcataccgcatagtaacaatgccagtccgtttaatttttatcatatgagattgtaacagaaaatgctctgttaatgagtataactgatagaagccagatattgtattcctgctatgactgcattcatcgacatgtgaagtaatatgggcattaacaggccattcgactttatttttgcactaataagaactaacgataccagaaagagcatcaaaaatgtatgaaagtcagtatattgtagatgtaatgcagaaaatatgactgatgttacaatagcagaggtgtaaatattgtcattaaaccagaatttaaaagagttaaaaagacaccctcgaaatacaatctcttcatatacaggaacaagaagtacagaagaaaatatattaatccataaaatggctccggaaaaagacatttgcgagatcatccattcttccgttttcctcactgccagcagataagggacaaataactgaataatcattattaaagagaaaagagtaaaaaaaacatccagtcgaaaagaacctcttcctaatccttctctttttcggaagaaaataaaatacagtggaacaagaattagaaattcagcaagaaataatgctggaacaagaagtcccctggatataagttcctgcctgtttgtaagaaatgcaggaataaaggtaatagaaaatgataaagtaaacattgaaaagcagccggctgatgactgtttttttatagttgcatttttattttttgtcatttccatttatattcccttacttgttgtttaaaattcttttatataacaggaagaggtaaccatagaatgaacgtttattttcctgtatcagaacagccataacttttattttatagttgttatcagtgaatgaatgcaaactaatagaataatgagaaaaacaatggagaaaaaacgatggaccggacgccatagttcatattctcgtgtatcagcctcacgtatcaacctttctgaaatggtttcggtttccttacctcgttccagaatatgtctgtaatatttcctcatgacatataccgaaaactgaaaccagattaatatggatggacacacaacacataaacttctgatgatatcacccgggaaagtatcttgggcgggtaaaagaaaatcatatactctgaataaaatcatcatcgagataaatgagacgccagcacctatccagtattcgatatgggaagatgcagcattatatgcgtcagtaaaatttttctttcttaatgaaggtggaagtgctgaatgttcaggaatgctttttcttgtccagtatattttcatatagcaactcatataaaaagtgttctactttactatgatgatgacgatttataaaaggcttataatgactacttctcctttcattctcgaatatcacgataatgatagagataatcattatcaattgattgtgtcagtaattttgacttacatcacactttcatggtttaatcaggtgatttatttaatgaaaagagtgtgtttgtggatgtattgtgtatatgtcttaccgggcatctgttcttacattaattaatatattgctatttaagtattggtggtattgtcagtaacattcttttggttaatttagttattattcctcactgattaattgtccttccgttcttattgtttgtaacttgtgtttgtatcgtacctttcaggtgttgatgcgcgctttactgtgtctgcaccggcttgacaaaatccaacagggtttgaaaaggaagatttcgtgcaaataaccgaagccttaatttcagagccgggagacatccggcgttttgttcagcaggcggtggaccactggccgcatttgctggcattttacttcacactccattcggcagaaggaaacatcaacgggcaacagattcatgcattctgtactgccttttaccgacaggtgcaagaacatattactgagcgtaatcacactgccagtccagcaccgccggtggtattacgctggttgcgggaacaacatggaggagcaacaatacgatgcctgttgctgctcagccaggcgagcatttgccatctgcgggtcagtgccacagttgatgaagaatgttcgcaagtggtggatttactgcagcaggcctggcgggggataaacgctggcggacaatgtcgggtggaaaggtgttttcgggttacccggcctgatacatcagagcaatacgttgcgttaaaaacagctgttcagtctctgatgccactggttattgcaacaattatccggtgatgatcgggagaaatatcaactcttccgttaatttttacagactgataaagttttgtctgctgaatctttatacggaattcttttcagtatgtgtacacgaattgactctatggcggataaatactgttttaccttggcggaattaatcctcacgtcttcgccagcagtggcaggatgtcctggaggagtgtcggcagactgaggcggggcagaagaacggctgcatattacattgctgaatgtggattacgtcaccagttttgaactgccttttcgtctgcttttaacccggacgccacagctgattgttacacttcgggaagcatgggatatcagccagaaaaatgtggtgttcaacgataaacggtttggctgcgtgtacagcctgaaagccagtctttctggtgtgccggatatattccggtatcatctgtctcatcgtattcgccggatggttgggagtgaaaatacatcatcgccatggcagcaaattgcccgggaagtgaaagcgccccgtgaacgactgaagtatgcgctggaaacgggattgcaggtgatcgcactgaacggcctgttttggtcagacagtcagcgtctggtggtggatattctgaggctaagcgccaacagacgtgatacaggaaatcgtccgcatccccatttaccgtcttatatcactggcgctgacactgaaagcatggtcgtcagagactctgtctggcaaccaagggagcagaggccggaggtaattgacaggagccttgcgccgggttacgtatgttctccccggacagacagtctcagttcgtagaatctataaattactgctactgatgctgccggggaaaggcgtaacgaaaaaacagcctccgttaccggatagcaaggaggctgaatggagtttacaggatttgcttttgtataatgtctggccatgcagtaaaaccggacaggttttattatcatgtgaggtattctgacataaaatgctggatttttattttgtgacgaatgctgcaaaattgaatctgcactctgatgtaacttttatctgtttcagtgaagcatgcccacaaactgagttattaagttgtggaagaacagctctgtcccgcctgcatctctcctttcagaaaccagtatgttgccatgcctcgtcttaacggagagcgctgaaccataccttctttttccagtaataacaggtaatagcgtgcctggtaatccgttaccgccagcgcctccgcaatttctgcggttttccctccattatgtctgctcagaaaacccattatttcattctgcatatcatcatcctctctatataagcaaaaggataataagtggctgacttgtttttgacaattcaaatgtgatcatcatgtttttatattgtatttggtgtatttacttaatatgcgaaacatattcacgattggatttctatcacattatttttatagttttttcaatggtaaggaacgttgcaaaaaacgattttaacgatcttttatactgaatattcattcttatacagcattaatcactaaggcaccaatccactgcaagatataaccctaaaaataaacagctttacagatcaaaagatcgtcaaaatacatgtttacaacataaaaaactaaatatatcttaaggagccaggccctcctgtatgggggatgaatattaaggcagccctgtaggtggcggggtggggagtatcgaatggcacagcatgaagttattacccggggaggggatgcttttttactaaaattacgtgagagcgcgctgtcatccggctccatgtctgaagaacaattttttttactgataggtatttcctctattcacagtgacagagttattctcgctatgaaggattatctggtcagtggtcattcccgtaaagatgtctgcgagaaataccagatgaataatggatatttcagtacaacgcttgggcgccttaccaggttgaatgtcctcgttgccagacttgctccttattatactgatagtgtatcagctatagctgaagctgcttccctgtaaaatacggacaataaaaaacgccggggcaatacataatacgcgagaaatataagcctgcagtcaaatgagagtgcgggtattatcaacgaggcatgctttcattctctgcttttgctaaagcattcagtgtggagacaggagtgctaactcatagcttatcatccagggaatcttatctatagagaagattcctgtcggttaaccggaaaatattatcgggagataatgtcataaatgctgcctgagtgtatttctcacattgcatttatgaagttctcctgaaaaaagattcccgtcgttcgggatattgattgtgtctgttgtgatgacagatacggtgtgcgtagttcaattaaaaacaggaattaaatatgaagttaaaattcatctccatggctgtattttcagctctgaccctgggtgttgcgacaaatgcgtctgctgtcaccacggttaatggtggtacagttcattttaagggtgaagtggttaatgctgcatgtgctgtaaacactaactcattcgatcagacggttaatcttggacaggttcgttccgaaagattgaaagtagatggagctaaaagcaatccagttggatttacaattgaattaaatgattgtgactcgcaggtgtctgctggtgcaggaattgtcttttcaggcccagcagttactggtaaaacagatgttcttgctttacaaagttctgcagcgggttctgcaacaaacgtcggcgttcagattactgaccataccggcaaggttgtacctttagatggaactgcaagctcaacgtttacattaactgacggaaccaacaaaattccatttcaggcggtttactacgcaactggacaggccactgctggtattgccaacgccgacgccacctttaaagttcagtaccagtaatatcagaacagtgtaacggatatatacccggccagggagggctgtttttatccatgcgggtgtgagattaatgaaaatatcgaaaatggcaataatgttatttttgctgtctcccgctgcactggccggaaaccactggcatgtcatgcttccgggaggaaacatgcgcttccagggaaaaataattgctgaagcatgcagtcttgccctgtcagacaggcagatgactgtggatatggggcaacttagcagcaatcgatttcacgccgccggtgagtatggggactctgtgggctttgatattcaccttcagggctgcagcactgtcgtcagtcagcgggtggggatttccttttatggcgtgtcagatattcacgagccggagttgctgtcggtggatgaggagaatgatgcctcagacggaatcgctatcgctttatttaatgaaagcggagagctggtaaaacttaatcagcctccggagaactgggtgcatcttacccgcggagatatgaaactgcatatgcaggcgaggtataaggccacacattatcccgtcaccgggggaaaggcaaatggacaggtatggttttctctgacctatctgtaactggcagatataacgccatttaattaaggctgttaataacatgatgaagcacatgcgtatatgggccgttctggcatcatttttagtctttttttatattccgcagagctatgccggggttgctctgggggccacccgtgtgatttaccctgaagggcaaaaacaggtacaactggcggtaacaaataatgatgataaaagtagttaccttattcagtcatggattgaaaatgctgagggaaaaaaggatgcccggtttgtaattactcctccgttattttccatgcagggaaagaaagagaataccctgagaattattgatgccacaaacggacagatgccggaagacagggaaagtttgttctgggtgaatgtcaaggccatcccggccatggataaggcgaaaaccggcgagaattatctgcagtttgcaattgtcagcagaattaaactgctctaccgtccacagggactggttattccgccagaacaggcaccgggtaaattagagttcacccgtgaaaacggagggctgactctgtttaatccgacgccgtattatctgacagtgactgacttaaaggccggaaataaaagtcttgaaaacaccatggtacccccacagggaaaggtcactgtgaatatccctggaggatacaccggaggagatattacttataaaacaattaacgattatggtgctctgactgaacaggtgaagggtgttgtgaagtaactcagttatttctggtactggttgtgtttggctgctgattttattttttcgctcagtgtgggggctgacatgtttttcggagatggcggacagctcctgtctgataaatcactgaccggctctgctggcgggggtaataacagaatgaaatttaatatactgccgctggcattttttatcgggataattgtttctccggcccgggctgagctctattttaatccgcgttttctgtctgatgacccggatgcggttgcggacctgtctgcatttacacaggggcaggagcttccgccaggcgtgtaccgggtggatatttatctgaatgatacgtatatctcaacccgtgacgtgcagtttcagatgagtcaggacgggaagcaacttgccccctgcctgagtccggagcatatgagtgcgatgggggtaaaccgttatgccgtgccgggtatggagagactgccggctgacacctgcacatcactgaattccatgattcagggtgccacattccggtttgatgtcgggcagcagcgattgtacctgaccgttcctcagttatatatgagtaatcaggcccgtggttatattgcgccggaatactgggataacggaattacagcggcattgctgaattatgacttcagtggtaatcgggtgcgcgacagctatggtggcaccagcgattatgcctatctgaatctgaaaacaggactgaatatcgggagctggcgtcttcgggacaacaccagctggagttacagtgccggaaaggggtacagccagaataactggcagcacattaacacctggctggagcgggatatagtttccctgcgctcccgtctgacgatgggggacagttatacccggggggatatttttgacggtgtaaatttcagggggattcaactggcctctgatgacaatatggttccggacagccagagagggtatgcaccgacaattcacggtatttcccggggaacatcccggattagtatccgccagaacgggtatgaaatttaccagagtacgctacctccaggcccgttcgagataaacgatatttatccggccgggagtggaggtgacttacaggtaaccctgcaggaagctgatggcagtgtacagcgatttaatgtgccatggtcttcggtgcctgtactgcaacgtgaagggcatctgaaatatgctctcagtgccggagagtttcgcagtggcggacatcagcaggataatccccgttttgctgaaggaacgctgaagtatggtctgccggcaggctggacggtgtatggaggagcctggatagctgaacgctaccgtgccttcaatctgggggtgggtaaaaacatgggctggctgggcgctgtttcactggatgccacccgtgcgaatgcccggttaccggatgaaagccggcatgacggtcagtcatatcgttttctgtataacaagtcactgacggaaacagggacaaatatccagttaatcggataccgctactccacacggggctatttcagctttgctgataccgcctggaagaaaatgagtggttacagtgttcttacccaggacggagtgatacagatacagccgaagtatacggattactacaatctggcttacaacaagcggggaagggtgcaggtgagtatcagccagcagacgggggaatcgtcaacgttgtatctgagtggcagccaccagagttactggggaacggacaggacggaccgtcagcttaatgctggctttaactcatctgtgaatgacatcagctggtccctgaactacagcctgtcccggaatgcatggcaacatgaaactgaccggatactgtcatttgatgtcagcattccgttcagccactggatgcgttcggacagcacatctgcatggagaaacgccagtgcccgttacagtcagaccctggaggctcacggacaggctgccagtacagcagggctgtatggcacattgctgggggacaataatctgggatacagcatccagagtggttatacccggggagggtatgaggggagcagtaaaacaggatatgcctctctgaattacagagggggatacggtaatgccagtgcaggatacagtcacagtgggggctaccggcaactgtattatgggctgagtggcggtattctggcacatgccaatggtctgacactgagccagcctctgggagatacgctgattcttgtccgtgcaccaggtgcatctgatacgcgcattgaaaaccagacgggggtgtctacagactggagggggtatgctgtactgccttatgcaacagactatcgtgaaaaccgggtggcactggataccaacacccttgcagataatgttgatatagagaataccgtggtcagcgtcgtgcccacgcatggtgccgttgtgcgggctgactataaaacccgtgtgggtgtgaaagtgctgatgacgctgatgagaaacgggaaagcagttccttttggctctgtcgttacggccagaaacggggggagcagtatcgccggagagaatggtcaggtttatctgagcggaatgcctctgtcaggacaggttagtgtgaaatgggggagtcagaccacggaccagtgtactgcagattataaattaccgaaggaaagcgccggacagatattaagtcatgtcacggctagttgcaggtaaagaggcagggaaatggtgaaggatattattaaaacagtgacattctcctgcatgctggccggcagtatgttcgttacctgtcatgtctgtgcagcgggttctgtggtgaatattacaggcaatgttcaggataacacctgcgatgttgacattaactcccgaaaccttgatgtcagtctgggaagttatgacagccgacagtttaccgcagctggtgataccacacctgcgtcggtatttcatgtcgggttaacctcctgcggcagtgctgtcagtgcagtgaagctgacatttacgggcacaccagataatcaggaggcggggcttattcagattaacagcataaatggagcgcggggtgtggggattcagcttcttgataaggataaacatgagctgaaaattaatgtgccgacaacaattgcgttaatgccgggaacacagaccatagcgttttatgcccgtctgaaagccacttatcttccggtaaaggccggtaatgttgatgcggtgattaattttgtacttgactatcagtaaatataacacagaggaaaacagatgaaactgaaagctattatattggccaccggtcttattaactgtattgcattttcagcacaggcagtggatacgacgattactgttacagggagggtattgccacgtacctgtaccattggtaatggaggaaacccaaacgccaccgttgttttggataacgcttacacttctgacctgatagcagccaacagcacctctcagtggaaaaatttttcgttgacattgacgaattgtcagaatgtaaacaatgttactgccacctttggtggaaccgcagaaaatacaaattattacagaaatacaggggatgctactaatatcatggttgagctacaggaacaaggtaatggtaatacccccttgaaagttggttcaacaaaagttgttacagtgagcaatgggcaggcgacattcaatcttaaagtccgtgccgtaagcaaaggtaatgctggtgcgggaagtattaattcacaaattactgtcacctatacctatgcgtaaatattatcccctctttaagaaaagcaccgtcctcgagggctgtgttttattcacatttataatggcatattcccagccatcgtttgcactgttgtgcagaaataaccagacagggcagacttttcagtctggagacagtcgcttcaatatcactctttccccaacagttcagtatgataaagccattacagttctggatttaaatcaactggtgttatgtcagaatgaagatgcctctggtcagaactatgactatctcagggtcagacagggaaccggtttttctccttcattagatgctaaaacatacggaaggctggactttacaaacaggctttctgggtatagtcagacgttaccgctgcagcaagacacaaagccaacagaagcttactggcaatatggtgtatggaaacctttcccggcaaaaatgtacctttatcctgagccgggcgttttcgggaaactgatacatgccggagaattagtggccacagtttatgttaataagttttccaccatggggcaggaggcaggggagagaaatttcacctggcgtttctatgcaacgaatgatgtctatatccagacaggtacatgcagggtctcatcgaacaatgtcaaagttgaccttccgtcctatcccggagggccggtaacagtccctcttactgtacgttgcgaccagacacagtcggtcagctataccctgtcaggttctgtaacaggaagtggtaatactgtattcgcaaatacggcaacatcaggggccggcggtgtgggtgtacagttgtcggacaacgcggggctggttccggccggacaaccgaggtctctgggacaggtaggcagctctcctgtgagtctggggctgaaggcctcttatgctctgaccggtcaggcaagtccgacgcccggtgctgtccagtcagtgataaatgtgacttttagctacaactagaatgcagttgtggcggtaatgatattactgctctttatatccagtttttcatttaatgtatcactgtttgtggagaaaaatagctgataatagtattgtttccggtgttgtgacggaacgagtctgtcatatggtctttgtcaaagataaacagaaccagtatgagccgtatatctggttctgagcgttgtcagtaatcataaagataatggtaaatctgagggtttaaaaatcaaatcagaagaactgcgcttatccagccagaccttctggtcgggaggggctcatatttccggaggagtaatgtcaggggcagttaacagtatactggaggtgaaatcaggcagaacagaatatatcctctcaccggtttttgagcctgtatggaatcagaccgggaaaatatttgcttttgaaatgctctcggatatccgttcagcaaaagacgggaggaaaatctgcgcatctgtttttttcagaagtgcacctccggatattcagtacaaaatactcatcagtcagttgaagactgcggaaacgcttcataaatggtgtctgcagaagaaaataatgctgagtgtcaatatttcccgggtggtagccctgtatctgagaaaacatggcatcccggggcggccgggaacacatatcaggcttgaggtcagtgaggactttccggcagtggcgttaaaacccggtgatgaccccctgttacgttttttgtcagaacgtttcaccctctggctggatgatttcggctcaggaaatgcaggcttaatgtggggactgtccgggatgtttgaacgggtaaaaataagtcatgagttttttcattatgccctgaaaaacaggtgtgcaatgtcgcttctccatgctgtggcagactctgttgcctgtcataaccggggcgtgatacttgaaggtgttgaaaatgaagcgttgttccgtattgccagagacatgaatgtccagggctgtcagggatggctctacaggcgtgtggaagctgatgaattatccgcgattactgagctgcatggataatcctttttcacagacttgtcagcagccagcatttatgttcttttatctgagggaatttatctgtccgctgtgccgggatatctcagttatacagaaatcaggcaggaataaattgtagtggaaagtcgatgtttaccggatgactgatgcgcgcttgtacacagacagtgtgtttcagtaatatggagaataatgaaatgaataacacagacacattagaaaaaataatcagacaccaaaaaaacaaagaccccgcatatccctttcaggaacatttgttgatgcaactctgtattcgcgcaaataaaaggatgcaggataatatatctgaatttctgggggcgtatggaataaatcactcagtgtacatggttctcaccacattattcacagcggagagtcattgtctgtcaccttcagagataagccagaaactgcagtttaccagaactaatattacccgcattacagattttttagaaaaaaccggatatgtaaaaaggacggatagcagggaggatcgccgtgctaaaaaaatcagtctgacatctgaaggtatgttttttattcagaggctcactcttgcacaaagcatgtatctgaaagaaatctggggttatctgacccatgatgaacaggaactgtttgaagtcattaataaaaaattactggcgcatcttgatgatgtcagctcataaagtgtgaaatgcctgacttgttgaaagcagtagtgttgcagaaagacctggtgatgctgatcttatatacataagcagcgcccgtgtctgaaatgcaggttagaaacaatgtgaacactatccgttagaaattgtgacaaaattcccgatgatcgacaagcgcaccgattttccagtggcaacatcagtacaaaagatgaacggtactgactttgccggaatgagtcaaaaagaaagctgaactggcactactggcagtgcttcagaaatttatttgactgaagtacaatgaaataaaaaacatatgttatatactcaataaacctcaagatgcgggtgtgagcacctgaaagtgatcgttaattcgggatgtcagtgagtccgctatatccggcagtgtctggttaaaaaagacagatattgcttccctgaactctcgcgtactgctgaagtagcgattattccgggcatgttcgttcattaatttccacattctttctatcggattcaggtttggactgtaagggggaaggtaatgcagcctgatatttaccacttccgcccagtctttcactaactgtgaacggtggtaacctgctccatccagaataacgtggattttttggttataatcaggataaacctttcgtatctcattgaaaaaacgggatacattatattcattaatggttttatattcgcagattagcggtgacgtcagtgctttcagattcagcgcccccatgatattcaggcgtgtgcggctgcctgttgtttttactgcttttttctggcctttgcgtatccagccatagctgattttagtggcctgagtcggatggactccatcaataaaaagaatcggctcatcacccacagttgttttcagttccttatagtattcaatgaattgcctttgtttctcttcactgaatttatgggggacgcctgacggttttttgtaggtgacaccattacgatgcagccacttattcatccccggaatgctgaaaatgatgttccatgtccgggtgacaaacgcaataacatcgcgggtatggtgaaataaattatcggataactggctgattaaaaaggccgtttgttcagcactgagtttgctgtctgagccgccgttttcgggcttcagttttcctttattcaggaattcgctgatatggtgatcaatcgttgtctgatgcaggcgtaaagcctgagcaatcatggcagaactccagccttcggaagccagaagaatggctttaatacgatctctgactcgcccgtcacgactggaatcatgaaggcgttcaagttcagctttttgttgctcagtaatgaatattttcatgttggacagcatgatcttctgttgctgaaaaatcaagcatcttcaatgatcacgggtatatatcaatttgatatttatgaaaaatcaatagatttatcttgtgagggattgctttttcttttgctaaatgatattaattatcattcttatataaaaacaataatggcagtaagaaatatctggcaaggatgtgagcttaacgatcaaacattttaagttaggcatttattagggaataggaatgagaattaacaaaatcctctggtcgctaactgtgctcctagttgggttgaatagccaggtatcagtagccaaatactccgacgatgataatgacgagactctggtggtggaagccaccgctgagcaggtattaaaacagcagccgggcgtgtcggttattaccagcgaggatattaaaaagacccctccggtaaacgacctttcagatattattcgtaaaatgcctggtgttaatcttaccggcaatagcgcctcgggcacacgcggtaataaccgccagatcgatattcgtggtatggggccggaaaacaccttaattttaattgatggtgtaccggtgacgtcacgtaactccgtgcgttatagctggcgtggggagcgtgatacccgcggtgacaccaactgggtgccaccggaacaggttgagcgtattgaagtgatccgcggccctgcggcggcgcgctacggttcgggggccgccgggggggtggtgaacatcattaccaaacgtcccaccaacgactggcacggttcgctgtcgttatacaccaaccagccggaaagtagcgaagagggcgctacgcgtcgcgccaatttcagccttagtgggcctctggctggtgatgctcttaccacgcgtttgtatggtaacctgaataaaacggatgctgacagttgggatattaattctccggtcggtacgaaaaacgcagccgggcatgaaggggtacgtaacaaagatattaacggcgttgtctcgtggaaattaaatccgcagcagattctcgatttcgaagtcggatatagccgccaggggaatatctatgcgggcgatacgcagaacagttcttccagtgcagttaccgaaagcctggcaaaatccggcaaagagacgaaccgcctgtaccgacagaattatggcattacgcataatggtatctgggactggggacaaagtcgctttggtgtttattacgagaaaaccaataatacccgcatgaatgaaggattatccggcggtggtgaaggacgtattttagcgggtgaaaagtttacgaccaatcgcctgagttcctggcgaaccagcggtgagcttaatattcctttgaatgtgatggttgatcaaacgctgaccgttggtgcagagtggaaccgcgataagctcgatgatccttcctctaccagcctgacggtgaatgacagagatatcagcggtatttctggctctgctgcggatcgcagcagtaaaaatcattctcaaatcagtgcgctgtatattgaagataacattgagccggttcctggcacgaatatcattcccggcctgcgctttgattatctcagcgactccggcgggaacttcagccccagtctgaatctttcgcaggaattgggcgattatttcaaagtcaaagcaggggttgcccgaacctttaaagccccaaacctgtatcaatccagtgaaggctatctgctctactcgaaaggcaatggctgtccaaaagatattacatcaggcgggtgctacctgatcggtaataaagatctcgatccggaaatcagcgtcaataaagaaattggactggagttcacctgggaagattaccacgcaagtgtgacctacttccgcaatgattaccagaataagatcgtggccggggataacgttatcgggcaaaccgcttcaggcgcatatatcctcaagtggcagaatggcgggaaagctctggtggacggtatcgaagccagtatgtctttcccactggtgaaagagcgtctgaactggaataccaatgccacatggatgatcacttcggagcaaaaagacaccggtaatcctctgtcggtcatcccgaaatatactatcaataactcgcttaactggaccatcacccaggcgttttctgccagcttcaactggacgttatatggcagacaaaaaccgcgtactcatgcggaaacccgcagtgaagatactggcggtctgtcaggtaaagagctgggcgcttattcactggtggggacgaacttcaattacgatattaataaaaatctgcgtcttaatgtcggcgtcagtaatatcctcaataaacagatcttccgatcttctgaaggggcgaatacctataacgagccaggccgggcttattatgccggagttaccgcatcattctgatcgtagtgtttcaggcgcactgcccgcgtaaaagcgggcagtgtttagtggcttaactcatgacaacctgctgtgtaatttgcgttttcaccactgatatctaacagtgcctggcgaaaggaggcattgaacatcggcccgtgtcccaggttggggaaatcccaaaatacggcattgacgcctttatctttcagtatagtgagggtggtatgaattttcgacagcaccccgacagcatgcgtttcccggttatcaccctgtgtcgccgagccttccattatcgccaggtgtttggtgcagaattgcagaggctcaaccgccgtaacgcggcttagcaaagcatcataacctctgcccaacgacgggctggcgctgtagtacgaccggaagtaagaggaggacagccaggaatccagcacgaagaggccgccgtaggagtgcccccataagccgcggcgttgccgatcgatattcagtccctgttccacttttggggcaatacgcgtttccagtaactggcggaagttgttgctgccaccactcttacggctaaaacgccctgagtggagatctgtttttctgctttctgctgctggcgtatagtcgtaagccctgctgttgagatcgaaagggaggttggtctgatacccgacagccacgatcactggcggtgttttttctgacaattgtttgagcagttcgtcatccaggcggtccataactgcgttaccgtcaagcatatataaaatcgggtaacccgatgccggtgcggttgtattcggcacggccgtccatacccgataatggcgtgtgccatcgacagagtcgaaagaggtggcgctgaaatggtaaaacacggagcctttatcggctatattcggccccagtggccgcatatccggcttcgcataaacttgcgcactacagataagggtgaggcaagaaagatgaaagaaaatcgctttatgcgggcgtgttgagcgatactcgcgggcatacatctgatgattattccttttccgcaggtgacaatttgatttattcaggaagtctgtaccgtttcctgaaagtgtttgtgggtcaactcaaccctgtagtaaaccaatcccgtcaatcagtgcaccgcgccaccatgcgtaatcgtgaccaccggtgtagattgcgcaatggctttcgacgccagcggtaatcagccgctggtgaagttgctgaacgtgaggaactgtcgaaccttccagcgatcccacgcacaggctgatacgcacgccctgcggtggggcagaaagcagatgctcactcacccatgaggtatcggtttcgctgaacaagcctggtcgactggttctttctggcgtccaccacattgaaggagagtggctgagcaccagaccgaacgtttccggtgcgtaacgagcccccattagcgcactgatcccgccgaggctctgcccggccagcactgtgcgcgaacggtctgcccactgacgctgcggttgttcagcgcggatcatcggcagcagatgccctgcgatatcctttatcagcttgctgcgcccgccgagtatctcagtgcgttcatgttcattaatgttgtcaatgcccagtacagccacgggcacgatgcgcctgttatttatggcggcgtcaattgccgcgcatacgccaaggtgatcaaaccaggtttcaccatcgggcagcacgaccagcccgaggggctgagaaatatcaatgtccggaatatagagccgaacctggcgagatttcccggcgataatgcgcatggaggtaagcagttgtccggtgtggaagccgccgttccattccgacagggcgggagctttatcaagtgtcagcactgattcctttgcgtttccccgaacgttgatctccggcattttgtttagcggatcggcctttccggcgagggtggcaaaacggcctccggacagtgcaatcgtctcagccgtagtgccgggggggatttccagcagcgaataggagccgcagtaacttgcgggtaaacgcagtgtcagtgtccagatatccgtttcgggaagggcgctcatcattcctttttctacgtgctctttatccgtcacccggttcagacgcagataaacgccctgcaggggatgtcgggcgcgccacagaaaggtcacttctcgctcatcttccgctccttcgactggcgtcacaagaggaacattcagcgactcagcttcgcgccagaagtcagtaaggttagcaatgtggcccgctgccagttggttgcgcaggctggcgatagcagagggatgttgttgcatgttcagcattcatactctttaaaaattaaggatgtcagtataaataattaaagcggctattcacggtaccgccgcttctgactgtgtttttaatacattacgtgtccagtaactatcccggggtttcctccttcatgttgtgctggcgatggagcgcagtactgctgacgctgtcatgccataagcgggtatagaggccgcctgcagataacagctgttcgtgggttccgtattccgcaagtaaccccttatcaataacggcaatcagatcgcagcgttgcgcggtggtcagacgatgtgcaacaatcagcgccgagtgcttcccggcatgcacgacatctgttaacgatgacatcagtcgttcttcggatgtgcgatccagacatgacgtggcttcgtcgagcagcaggatgtgagcattcgccagttgcgcgcgggccagcgcaatcaactggcgctgacctgcggacagatcggctccgccgttattcaccggtgtccggaatccctgcggcagattgcacaccatctcatacagccctgcccgctgtgaggcaatttcaacgtcttcattggtggcggatggccgtgaataacgaatgttttctgcaatatcactactaaacagtgctacatcctgatcgacaagcccaatctggcgacgatactcagtgagcgaggcatcatcgagcatttgcacaccgattctgatgttgccgtgcgtggggaaatacaacccggcaatcagcttaatcagcgtcgacttacccgcaccgctgcgaccgacgaccgcgacaaccattccctcagggatcgtcagggtaagtttgttcagagctggctcgtgactgtcgggataactgaacgtgacctcatcaagatgcagtgcaccggtgacagggaggaccgaagaggacccgaggttctcagtgccttctgtcgccagtagttcatcaatatgtttgccgctggctgtcgcctgctgccaggcgtcgacaatccctgataactgctgcactggcccatagaattgccccagcaacaggaagaaagccgccagtaccccggcagtcatttctccagcggcgacctgcgaagctcccactaacagaacggcggcataggaggcctcggtgcagaatgtcaggaacggaaaatagactgcaaggtatttttgtgctcgcacacgggttgcgcggaaacgctccgataacgcgcgcagccgggcgccctccagttcctgctgaccatgcgattgcacgacacgcaggccggagactttttcctgcagggtgctgttgactttgcctatttccagccgtgcttgtgcataagcaggggtactgaggcggcgataaatcatggttgccagtgcggccactggcactgcgcttaatgccgtcagcgccaggatcgggtcgagccagaacatggtggcggcgattgcgaacatcgtcaccagactggtggccgcaccggcaaggccgttttgcagaaagcgggcgagagagtccacatcaacggtcatgcgggtcagacgcgaatcggcatgcttttcgtgccaggggagtccaagacgcagcatatggccgaagctacgcaagcgcaccgaatgctgaactgattccgccgctctggcggcgaagaccgtctgcagagaataactgcaccagcccacaatgactaggcacagggcgagcagggcacagaggccgatggtcgacatatcgcctgcggcgacaccggagtcaatgccgtgctgcaacagtatcagcacccctacgcctgctgcagaatcgagtgcgatcagcagagcggcgatgacgaacatccatgccacaggcttcagtagtgacgtgactttgcgacctttaccggccagcgcctgctgtactgcattttccggtacgcgggtcatacgggcgacaaaacctttatcccccgtatccgttacatcgtcttgtgtcgctggttcagccggccacaattcgttgtggctattgtgggacgtggccagaaaatcgctgtcgccggtcatcagtgcgcggaacgccggacagcgcgcttcaagttctgccggggttccggtatccaccatacggcccttatccagcaccacaacccggctggctagctgaagcgttgaacgccgtcgggcaatcaccagcagcatatgcccttcgtcagcatagcgacccagcgcggtattaatctccgcttccgtaacagcatcaaccgctgaggtggtatcatccaggattaacacgtccggtgcagtaatgagcgcccgcgccagcgctattcgctgcctctgcccgccggaaagattcgtaccccgttcggttaacaggctatcgaagcctttcggcagggcgttgataaaatcgctggctcctgcagcagctgccgcacggcgaatgtcgtccgccgttgcctgagggtggccataggcgatattttccgccaccgtaccggcaaacagaaaagcatcttcaaatacgatgcctacccggcgacgaagcgcctccagtctgatatcgcgaagattttgtcggccttcgctggtgttgagccatatctttccggagcagggatcataaaaacgcgccagcagcatcaacagggtcgattttcctgaacccgatgcgcccaccaccgccacggtttccccagcgcgcagggaaaaggagatatcgctgaggatatgtctgtcgccatggtggtagtcaaagctcatattctccagttccagtccgacaacctgactgttaatcgactccgtcccgtcctccatctgtgaacgggtgtcgatcagtgcaaacacccgctccacggacgcctgagtgcgctgtgcgataaccagaaacgatgccagtacgcgggttggcccggtcagcatcgcgaggaagctggcgaatgcaacgaaggtaccgagatcgatccgcccgtgcatgaccgaccacccgccgtagcacagcaggacgatttgcccgagcaccggtagcgccagcatagtggccccaggcatcgcctgcgagataaccgcaccgatgcgtacacgcacaatctgccgcgactgcctatcgagccagtgcgtttcacgcatctctgccacacaggattttaccactgagatctgtgccagcacctcgcgtatatgttcggtgagattcgccagttggtccgaggccattccggtttgcgcgaagaccctacgacgcgcacgaagcgcggtgatcgccaagcataccagtacgcacacgacgataagcgtcatggcaggggacatccacagcatcacggcaatgccggcaatgtaataagtgaacactgccagcggcaccgggcacatctgcagcagggtatgcacctgctgcagatcgctgttggtccgtgaaatcacctgcccggtgcgcagcgcatcctggcctgcgccgtcaagtttttgaatactgtcgaatacccgtcctctgagggtatgctgcacccagagtgagagcatcccggcataaccacggcgcacatagttaccgatgaaatcaaaaaaagcgatcaacagtaacccgcaggccagccacggcaggcgggccggattgcccgccagtgcgtcattcacagcctgtcttgtcagcagtggcgtcagcgcagccagcaaaatagtcgatactgacgctaccaccacgatgacactaagtttcttacgttcccagcacacgcgcgccaggcgaactatccatgactgagccggtgtgggagtgtgattcgcaggcattaagcctcctccgtctgtaaaatacgatccactggccggatcgttccgcaaaaaagccagcacactccggtcccgcattgttatggatgcatgactcctggatgggggctggcaaatgattatcatgaaggtgtagtggctaccctttctgtaccattgtgatcaggcttttcgccacttcaccagggcagggttgcgccgccatttccgctgctacctcttcagaggctttgcgaagtgagcgattgttgaggaaagcattgatcatgttactcgacaggccgacgtcgccggggataatcccgcagccgcgttcggcaacaacgcgggcatttaccgggcgatcggctccctggccgaagactatttgtggaataccagcgtgtagcgctgtcagggtattgcctgctccgccatgatgaatgaaaccatctgcgccgttgaggaagacacccatgggtatccagtcaaccaggcgaacatttgatggcagcgagcgcaaatcggaccgcgcattggctgaaatatgcaggatgatctcggcatcgacctcactggcagaatccataacccaggcgattagatcaaggccgtcaaccatcggtttgacagtgccgagactcaccagaagacgtttacgatcgggccttctctcccaccatggttcccacaccgcaccaccgttatatgggacgtactgcatcggaataatgggttcaccgtcgttttccagaatgctcatactcggcggtgttacgtcgatccaggccatatcgcgtggtgtggccccgacattgtggcgacgataggcgtccgtgagcgaacgcgttacacccctgatatgccagggggtatggccgaagcctacggtttgcatcacgaccggtatatcatatttggcggcaatcagcggcccgatgactccgagtggagggtagatgatgaggtcaggccgccagtgtccggcaaactccaccagatggtctgccatttcttcgctgaagaatgagaagttgcccatttgggttccgatgttactttttttccgctgtgcctcatggtggcggtaaccagcttcggaatccagaccgggggcagcgtcaaacaccaccaacccggcctctgccgctttttgtgcgaattgtcctccgctggcgatcagtacttcatgaccgttaacgcgaaatgcctgcgccagggacagcacaggatacaacagcccatagagaggcgggcctacaaacaaaatacgcatgagaaaatccctctccgcttgacgatctaaatcaggcagtcgacgcactcatatgccagcagcaggacacgacttttcgttaaacctgctttaccagatgctgcgccatttgtgcttcaccagcgttatggacagatcagtcagagacttttccgtgacatacacaggtgaacagggaactccgtatccccacttccattaacgcttacgcgccattgtcctgttgaacatcccggcgtcagacagctacgccgggatgttcttacgcatttgtgcagtgttagaccgacaatgaatctggaaagatccgtgactttttagacacacggcttgcatcatcctgatagtctcgccttcgctggcctgtaagtaaaatgaccttgtactggcgatgcgtgttccctttcagccttaccagagacaacgttagcgcaaatgctaatgataataattaccaatatcattaaggtattgcaacgataattaaaaacttaatgaaaagggaagcactcagaggactatccgggggtatttaaattgaaacctacgctgctccagaccgtggagaatatttgcctgcaaattctgttcgtgctgttcctgttcaccggaacgctgatagacgttgaggcattggtgagctgttcttccgttgccaaaaatgtacagagaactccggccagcagcgtttcatcctctgtctatagcgcaagcgtgtcgagaactgctgctgatattatgctgttgtcgaataatccgctttttgctccgggtcaggtgagttttttcggctgttcgttggcagcgtcaggtattcacgtcaccattctggagtaatgccagtcaattaagcaactgactggctctttttgtgcacagaaaacccccagctaggctgggggttccggaaagctttcagctttgagccagttattaaaaccccttttgatttgttaaaacaccttgcggtctggcaactgcaagtgtcaaacaagaaatcaaaagggggtcccaatggggaacgaaaagagcttagcgcacacccgatggaactgtaaatatcacatagtatttgcgccaaaataccgaagacaggtgttctacagagagaagcgtagagcaataggctgtattttgagaaagctgtgtgagtggaaaagtgtacggattctggaagctgaatgctgtgcagatcatatccatatgcttgtggagatcccgcccaaaatgagcgtatcaggctttatgggatatctgaaagggaaaagcagtctgatgccttacgagcagtttggtgatttgaaattcaaatacaggaacagggagttctggtgcagagggtattacgtcgatacggtgggtaagaacacggcgaagatacaggattacataaagcaccagcttgaagaggataaaatgggagagcagttatcgattccctatccgggcagcccgtttacgggccgtaagtaacgaagttggatgcaaatgtcagatcgtgtgcgcctgttagggcgcggctggtaagagagccttataggcgcatttgaaaaacctccggctatgccggaggatatttattcggggctgtggggtatttctagggcctctcctttaccactctcgggaaggccgtttcccttcttgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctcagttgcatcgtctgttttatctctctgtatccctggtcaggttgacggggcactagtggtttcagcggttaatcgtcgaacaggcgcgagacaatattcgcattcaacaaaataacaaacgcaacactgatcgttttgttgagaggataactctttttcagggttatgggtgaaaggcctgaaaatttgcgattatctttaagagagtcacaaatacactccaaaaccaaaacccgctctctcattctttagactgaacttagcgtagctcaccatgtcaaaatgtttgaaactgctctggtgtgggaagtgttcgaaaactcgtagattgttatttcaatcagtgcgcaaaagagtgtcttactgaaaaatgaatatagatattcatctggcgattcgagacgaaaagatttctttcatccgcagttatgcgcatggttaagaggtgacgattgaagaagtcctgatcttactgaagttacgcggatagtgggtaatgccgcgagattgatggaactttaaaaattatctcttaacgttttacggatataaaaagtttattttttgttaagagagattacttcaccagacaacttgaactcgctgcagggcgttttttatgcccgaaaagctgcacagtacgttaaatatgctggtgattgtgcagtgagtttctccaagcctgatgtgacttgactgaatgatatcacatttgtaatgtaaaataaatcaatgtttttaagttgctaggtgcttgtttctatagctggggcacttccttttactatggctttccatggtggggggcggagctggtgttgatgatgtggccagaagcctgttttatgctgttacagtcatcgttatattccttattggatggggagcaggtattgttttctttctgggaattaaacaaaaaacaatatgaaggatttgagttttatcagattttttctggcaatattgttgcttcttgttcctcctgctctggagtttccagtaattcatcggcacattacgccaggtgcactgactttatgcgtcattacagccttaataattacgctgcttgccagcttgggcggcaggcttgtctcagttaaatgtatttcggagatttcgtttattcgtcgtcaccggattgagtgcatgatggcgggatttatgatttatttctggacattctctcttattgctggttggtacaagccccagtttaagaaggaatatcagacactccactatgagaatgctaggtattacgttcttgcacgctatgacggtcgtttggttttatcacaatcgtacaggagcgggagtaggaagtttgttataatcaatggcggacatagactttgagattaatgtagtcagagtgcgttaaaattcccttagaaatcgggaataggtagtactagatacgcaggatttaatcagtcgtattgagatggaattgcagagttaaactggcatggattattttgtacccagcccttaagaacaatggtgagagatagtaactcataatcgccaattcactgttttaaatttagtaagggccgctatccgccactggctcatcgggaaagagcatcagccttctaagttgactgtgcgaggttcgagtcctcggtggcggtccagtactgatttagctcagtaggtagggaattgccttgtaatcagtaggtcaccagttcgactcttgctgtctcgccccatattccaataggctcgctttgacggggcttttgtatgtcgcttgcgatatgttacagtaccgttatcagtctgtagaaaatacacacaggagtgaaatgttaaattacccacaactcagagagcggagtgttgtcctgttagtggggaatttgttaaaagaatccagcatggtgaatctccctgtgcggctgtctcttgatcagatctcctgatcaagagacttcatcaccggataaccctcaaccatatcctgaagtctgaaccagccatcccacataactacccaaccagggcggcctgtgcgtttgctgtcatgccatcgccccagtttcagacaggcccatttcagtgtcggcgtctgtgacggaagctgttttccttccagcttaacccacagcagtttccactctgtcggcgtcagtattttcttacagctgtcattttgtgtttcttcactgataccttcctgccgcaggcccagcatccgtaccgcgataaacgccttgataaccaccatgcgctcaaggttatcccgggtctgcattcgcagtgattccacacatgtaccaccacttttccacgccttgtggtattcctctatcagccagcgtcgctcgtaatggctgacgatacgtcgcgcatcggcggcactcgccactttttctgatgtcagcagatgccagcaggcaccgtcctctgactgctcccggcaacagacatacgtgagcgggagcgcctggccgctgttgtcgcgatttttatgctgacttcgctgtacctgatgaacatccgggcctggcgggctgcccgccctcctttttgcatcacattcagcgtgtggcttcccgcggttgccaggacttccggcagttcgaagagcttgccgggtgcttcttccagccggctattctgtgcagtacgcaccacgaagcgctgtccgtggctgactttataatgcaggtaatgccagatatccgcttcccggtcacagacagtgattacccgtttctgtatctcccccagccgttcggccatacgctccgaagcctgctgccagcggtaactttctttttcttcacagggacgttcttttcgctggtgcttaacaccgtaggtgtccgtgacccgactccagcgctgctgttcgataaaaccgactggcagggcgctgtcaggggcgtacatcaggacagagtgagccagcagcccgcgcgtcttcgggttagtggtggtattcccctggtcatcagatgccgtactgtggctgaagttaatggtggtggtgtcttccagtgcgaggagcagcggatgagcctcacatgcccttacagtggcggtaaatccggcttcggcaatggcttgcggggacacagacgggttacgtatcaggcggtacgcaccttcaacctgagcagtggactgggatgatttcacaatagaaagacctgcatgctgagcgagagaagaggtcagtgacacaaggcgtcgtgtacgacgcggatcaccgagacgggcatgtccagactgctcgttatcccatgaataacaatcagaaagtaccataacagacccgaagaaaatgaaatataagaaaagatcaacgagtgaagaaaaagttcaaaaaatggctgccggggaggaaggaaagtaccggatggaaagagtcccccctaaagcagactgacagacataacaaatccccggggggatttgtgtataagagacagtacttatctggaggtaattgcaatatctctgtgaacttacacagggtgggcttaccgcatacactgacacttagcggatcgacagaacattattaacagagcatcactgaacgctacataatcagagttgcataaataaaatgttatgatataacatcacaatcacaacatttgttttcgaatgtatatgaatgtaatcagaactgtcatttgtacattaattatacttccggtgggattacaggcagcgaccagtcattcttctatggttaaagatacaatcaccattgtcgcgacaggaaatcagaacacggtatttgaaacgccgtcgatggtcagtgtcgtcacgaatgacacaccgtggagtcagaatgcggttacatcggccggcatgctgaaaggtgttgccggtctcagccagactggtgcaggacggaccaatgggcagacctttaatttacgcggctatgacaaaagcggggtacttgttcttgttgacggcgttcgccaactcagtgacatggcaaaaagcagtggcacttatctggatccggcactcgtcaaacgtatcgaagttgtccgcgggccaaactccagtctgtacggcagtggcgggctgggaggtgtagtggacttcagaactgccgatgcagcagattttcttccccccggagagacaaacggtttaagtctgtggggaaatatcgccagtggtgaccacagcacaggctcggggctcacctggtttggtaaaactggaaaaacagatgcgctcctttctgtcattatgcgtaaaagaggtaatatctatcaaagtgatggtgagcacgcacctaacaaggaaaaacctgcagccctgtttgcgaaaggctctgtcggtataacagacagtaacaaagcaggtgccagcttgcgtctctaccggaataacaccactgaaccgggcaattccactcagacacatggtgacagcggcctgcgtgacagaaaaacagtacaaaatgacgtacagttctggtaccagtacgctcctgtggataacagcctcatcaatgtaaagtcaacgttatatctcagtgatatcactatcaagacaaacggtcacaacaaaacggcagaatggagaaacaacagaacctccggtgttaatgttgtcaacaggagtcatactctgatttttccgggagcccatcagttaagttatggcgctgaatattaccgtcagcagcagaagccagaaggctctgccacactatatccggaaggaaacattgactttacatcgttgtatttccaggatgaaatgacaatgaaaagctacccggttaacattatcgtcggttcccgctatgaccggtacaagagcttcaatccccgtgccggagaactgaaagccgaacgcctgtccccaagggcggcgatttcagtctcaccgacagactggctgatgatgtacggctccatatcctctgcattccgagcgcccacaatggcagaaatgtacagggatgatgtacatttttaccgcaagggtaaacccaattactgggttcctaaccttaatctgaaaccagaaaataacatcacccgtgagattggcgcaggtattcaactggatggcctgcttacagacaatgaccggctgcagttaaaaggcggatatttcggaacggatgccagaaactatattgccacacgcgtggatatgaaacggatgcgttcttattcttataatgtatcccgggcccgtatctggggatgggatatgcagggtaattaccagtctgattatgttgactggatgctttcttataaccggacggaaagtatggatgccagcagcagggaatggctgggctccggcaatcctgacacacttatcagtgacatcagcatacctgttggtcatagaggcgtttatgccggatggcgtgctgaactttcagcatcagccacgcatgtgaaaaaaggcgatccccatcaggctggttataccatacattccttttcactgtcttataagcctgtaagtgttaaaggctttgaggcgtcagtaactctggataatgccttcaacaagcttgccatgaatggcaaaggtgtgccgctttcaggcagaactgtcagtctttatacccgttatcagtggtaacctcgcaggaaataaatcatgatgaaaaatacaggctatatcttagctctttgtctgacagcatcggggcatgtcctagcccatgatgtctggattacaggtaaacaggcagagaacaacgttaccgcagagattggttatggtcataatttcccctcaaaggggacaattcctgacagaagggatttctttgaaaatccccggctttataacgggaaagagacaataacactgaagccagcgtccacggattatgtctataaaactgagtctgcaagcaaagataatggttacgttctgtcaacgtatatgaaaccgggatactggtcgagaacctcgtcaggatggaaaccggtcagccgggagggcagaaatgatgtggcttactgtgaatttgtcactaaatatgcaaaatcttttattcctggtgaacagcagatgccagcacaactctatcagtctccaacagggcatgagcttgaaatcattccgttatccgatataagtcgtttcagtgaaaatgtgaagctgaaagttctgtataaaacgtccccgctcgccggagctatcatggagcttgactcggtcagttatctgacatcatcccgtcatactcatgcagttgagcacaaacatcctgttcataaagcagaactcacctttgtaactaatgaggatggtatcgtcacagtaccttctcttcatatcggacagtggctggcgaaagtccaaaataagaaaagttttcaggacaaaagcctgtgtgatgaaactgtcgatgtggcaaccttaagcttctcccgaaattaatgatactattcctgccctgtattttacgggcagggtatatcaaccggaaatagcctactgacatccatgtaaaaaaactcataattattttgttgatgtatcttacctaatacattgatagctccagtttttataccagagcattctcgttgtccctatgtacttgtctgcaatatcactgatatgcaggaataatattcttggcatggagtcagttccccgtcatcttaggtatcactttaactcacaggtgtccagtaaatatgaacaggatcccagtaatcattatcaatggtttccttggcgcaggaaaaaccactcttatgaaaaacctgctcacacaggcaaacaggaatcacttagctgtatctgtcattgtcaatgatatgagcgatctggatgttgatggtgtacttattgcaaatacagaaatcgttaatattgcgaacaataatttcgtgagtatcacatctgatagtatcagcagccagagtgggattaagacggtcgacaaggcaattaaaaatatgctcaggcattatttgcctgacgttatatttgtcgaaacatccggaggtagccacccactgccattaattaagtatctgcagactcatgagcgattacagctaaaatcacttttatcacttgtcgataccgttatgctcaatgatgactataacggagggaaagcactgatacctgcatttcaggagaatcttttccatggcaagcgcagaatagagaatttactggctgagcaaatcatgttttgtagcactttgctgttaaccaaaaaggatcgactgtcattcgacattgtcaccgatgtggcgaaagcaatccatcctctgaatccttacgtaaatgtgatagctgtgtcatgggggaaccttaaactagcagagttactaacccttccggattacgattttaaccgggtcggattacttatcagagaactggaagacacaatcacagtagaagaagcaaaaatttcagcccaaaatggcgaaataatttcgcgagtgattaaagatgacaggccattccacccacaaagattatgggaaacctatcattattttatgggaatgggtatttatcgtagtaaaggctttttctggctaccaggaagacctgacatggctctgctctggaaccaggccgcaggaagtatcaatctggagtttatcagctactggaattccggtgtattggcagaccctgataatcacctgacccacgaagagcgctctgttttgcagaaaaaagtcaataaaactatggggcggtttggagacaggagatgccatttaacgattatagggcgttctgatgaagtccatgattttacctccgccttaattaactgttttctttctgaagaagaaattgtctggtggcaatcaggtggcgttttcgcggatccctggcccgttaatatatcccggctgaactgatgattaacgcgatattgcaaatatggcatatgaatcgatcgtagtttggcattcgaatcgatcatgatttgggtaaacgttcacggagcgccgtattgacgtttatttattgggtgagtacgacgttccatggcaggagttcatcaacacggttagaaggccattccggcaggacgttgaggatatggcgcagatacgattccggatcgataccgttcagtcggcaggcgccgatcagcccgtacagcagcgcactacgctctccaccgtgatcgttgccgaagaacatgtagatgatatgacctttatatactcactatagcattggtgggatattccagaggaggtcatcatgtattcggaaaatattgcggcttacgtcgggctggatgtgcataaagccccctagcagttgctattgttgcatctgaacgacttggcaaggttcgttattatggtatggtacgattaacaacgaagcccagtctgtacgtcgattatttcagaaattgcagggactttacggaaacattctttcctgctatgaagctggcccctgtggttttgggctatatcatcaactcacagcgatgaatataaaatgctaggttattgcctcttcccagatagtaaaatcaccgatagacaggatcaaaaatgatcatcgggatgcaaccgctaccgtttgcctcgttctggaaataaccttgctgatgggggtatggtttggtacgttgtggggatttgtatgtggttttcttcatggaaagacagtggtatgcaaccgggcgttgcatttgtctcaagcatagtcgcaggcatttgctttggtgttctcatggctgtgtaccattagtgtcgaaaggtagttaacaatcttccagactgggacagtctggagtaaagatcgttgtagaggctatatactttttaaatggactgggggtgagatgggaaaaataaaatattggctaatagtaggatttattatactttttgcgattttttacattgctattagtgacagggattctacgctttctaggttgaaatcagcaggtgaaaacggagatgtagaagctcagtatgctttggggctcatgtatttgtatggagaaattctggatgttgattatcagcaggcaaagatttggtatgaaaaagccgctgaccaaaatgatccgcgtgcgcaggccaaactcggtgtgatgtatgcaaatggtctcggggtaaatcaggattatcagcaatcaaaattatggtatgaaaaggcggctgcgcaaaatgatgttgatgcgcaatttttgcttggggagatgtatgacgatggtctcggggtaagccaagactaccagcatgcaaagatgtggtatgaaaaagcggctgctcaaaatgatgagcgtgctcaggtcaatctcgctgttctatacgcaaagggtaatggtgttgaacaggattatcgacaggccaaaagctggtatgaaaaggctgcagctcaaaatagtcctgatgcgcagttcgctcttggaattctgtatgccaatgctaatggtgtagagcaggactatcagcaggcaaaagactggtatgagaaagcagcagaacaaaatttcgccaatgctcagtttaatcttggtatgctctattacaaaggtgagggtgttaaacaaaactttcggcaagccagagaatggtttgaaaaagccgcatctcaaaatcagccgaatgcccaatataatttaggtcagatttattactacggtcagggtgtgactcagagctatcgacaggcgaaagactggtttgaaaaagcggcagagaaaggtcatgtcgatgctcaatataatctcggtgtaatatacgaaaatggtgaaggtgtgagtcagaactatcaacaggcaaaggcttggtatgaaaaggcagcctcacaaaatgatgcgcaggcgcagttcgaacttggcgttatgaatgaactgggtcagggtgaaagcatagacctgaaacaagcaagacattactatgagcggtcatgtaataatgggcttaagaaaggttgtgaacggttaaaagagttattatacaaatagatattataatatttattatatgaggttgtgaattaatggcaatccctgaacgtatgatccccgtaaaagtcagcagcaaaaaaataagagaattagcacagaaagctaaagagatacttgcagctattgatagtggagcaagtgaagaagatgcttttttaaaggacatgatcgatgactggaacagtcaggtagtatgtccatgtgagttttcagattttagagattattcctcttggacaaatgcaaatgaatttacacgaatagcttttaatttggaaaagttctacgaggattttacttgggaggaactggttcaaacgataagctgtgtatgtgatcaaaagtcaaacgaatcggaaaaaatttttgctcttttgttgcttgaaaagaattttcatggaaatccatccgatcttatattctggcccgatgaatggtttcaggatccagatatgttagatgttgaactgagtgttgaagagattgcatgctatttgatggttcgatccggtaggcaactagttgatgcacctgaaatcgacctgaaatatcaaataccccagtctgacgaataaaaaattaatataagtgtagataaatagttatgagcaattacaggaaaaacaagtgtgaaaaaaactgatattgccctgtaaatttaattaattataatgtcccacacttacatggtggagaatatcattgggggcggagtaagaataaaagagttaattctgagcatccatacattttacctatgtcaggtaaaataaactatgggcttgattattcaccattattcatgtttctactaagaaaaacaggtgaaaaatcggatcaagtttatagtgaagcgattctacgactcgatctgcctgatccaaccttctttctagttgctctacacgaaacagaccaaagaaattttgttcggtgcggcaaatccagttattacaatgggctgtatgttgatgagaatggttacttgaaatgttttctccagatttaaaggcatcaggcataccaatattatgtaagtgctgtacttacactctaaacgggaaattattaaatgaataagttgaaatttttctgaccttattaacttaaagaatagacgcatcaattgttttatttcagggcgttaaacacattgtatttataattatgcaaaatttaccaatgttttaacagatccgatagtagctattgttgttttcggagtttggccctgagctgtccatgcctttttagaattatcagtatcaatagatggtaatacctccaattagttgaattaggggtataatagtcgcttttaaggttcttccatggtcacagttaaccttcattgtccctgttgccagcccgttcaggtttaccgtccaatagagttatacttagctgaacctagatttttagcttcgggtatttaaaaataggtattaagaagattgctaactttattgataataacttaaactgtttttagggagcataattaaatgtaattttaggtttgtaatttattatgtttttttgatatgcaaaaatataatgcgagtagaggtacgataaataatatacaaaacattaatacgaataagaataaattccttgatgatccagtatcactaaaaaatctatcccaggatttctttggtattatcttttgcgctgatatttctaaagcataatatgcaaacgggtatgctacagcaccaatagcaaggtatgctgcaacataaggtatataaggaatataagaaggaaatatctttccatcctttaaatcagtcaaaatgttgtaaaccaaagagccacaaccgactaagccccataaacaatgtctgagatagtatctaaatgtcatattatataccttaatgatatgaaatagggtacatatggattcaagtaggcagtttccgcaaactgaaagccattaactctgataggccgctatgagtgggccatttgggttttgcccatgatcacagtcatagttctggaaaatggctgtgctctttaaataaatgtctttaactcctcagtgtttatattcgccagcattgaagcctttaaatgtgggaatgtacgaggtatctggaaatcagtttaaaacctttggtatattccagccatcttggcaagtccccggttccgaacaaccaagcgttacaatcgtaatcagtactataccagttttcaagcaaatgcagcctgtacggttgaacaatatctgatgtgagtttttctctggggtcaggttcaccagcaaaaagctcaagcgaaaagtgccctgcaagcccttcagagactatgacttctcctaaagttgagccgtatctcggcccatctaacagcacgatgcagttcatgtgcaaacattcgagcaatggagtgcgcataatttttgcaaaattatggattttctggagctactgttctatagacaactccagcttcagggtaaaaaccatgatgccctttctccgggaggacaagtttccctactttaaccaccacgtccagtgaaggaatcggcattaaccttttaactagttcgtaggtatcagtcaggttgatttgaagccattcatagtgagcagtgagtttcttttgggtattaagaaaatagaggggcatttgagacataacggtaccactcaaaagagtcagtaaatcgctacatgttaacacacaacgtaaatgttgtggtgtaagcacagtagtagaggaccagactgttacccatcatacctgctcttagggcagagcaaacccaaaccatcaaaatagctctggcttttgtgtcatagctgtctcaggttaagtctgagctaatatattaattaaaacagtccattcgccatgtattattaaatagttagttaccatttgataattaatatgaaattacttcacaggaatctctctattattatttattcgtttttatccttcaggtaataggtcttcatataggtcaagcgatgaccattaaacatatagcctgggttaataaagtaatagttctgtatcatggtctctgcaataaacttcttgtcagcaagttctttcatgcctttgaaatattttttctggatctttttacaacatcttgatcgacaatattccatatagctggaaaaattttcgctgataaaacggttgaaaagtgcgcccaaaatgtactgtttaaaatcccatccgtcgacagaccctctgacatcattgaccatttgccctatcaggtgttgcagccctgctcgttattgaatgcctgtcatttttaattcgttttcctggttcaggtatgaatcatcaggggctattctacagcaaacgcgtggctcaggtagcccgtaagtaagtcggtggactccgggttattcatggcagggaggcgtggccgaatacttctctcctttgctgtatgtctggcacatcctaaataatttcagacagatattatctccgtgaatcccccgccacctttccggtgcgcggggttttgtctttttttaccgggaatacatgtatgaatccgtctgatgccattgaggcaattgaaaaaccgctctcctccctgccttattcactttcccgtcacatcctggaacatctgcgcaaactcaccagccacgaacccgtgattggcattatggggaaaagcggggccggtaaatcctcactctgtaatgcactgtttcagggggaggtcaccccggtcagtgatgttcacgctggcacccgggaagtgcggcgcttccgtctgagtggccacggtcacagcatggttatcactgacctgcccggggtgggcgagagccgggacagggatgcagagtatgaagccctgtaccgtgacattctgccagaactggacctggtactgtggctgattaaagccgatgaccgtgccctgtctgtggatgagtatttctggcgacacatcctgcaccggggacatcagcgggtactgtttgtggtgacgcaggccgataaaacggagccctgccatgaatgggatatggccggtattaagccttctcccgcacaggcacagaatattcgcgaaaaaacggaggcgctattccgtctgttccggcccgtacatccggttgttgccgtatcggcccgcaccggctgggagctggatacgctggtcagtgcgctcatgacagcgcttcccgaccatgccgccagtcccctgatgacccgcctgcaggacgggctgcgcacggagtctgtccgctctcaggcccgtgaacagtttaccggtgcggtggaccggatatttgacacagcggagagcgtctgtgttgcctctgttgtccgtacggccctgcgcgctgttcgtgacaccgtggtctctgttgcccgcgcggtatggaactggattttcttctgaacctgttgtagatgatgccctccctgcctctgagccatctcacaaaaagcgcggttttcattgccacctttcttgtccgtgcaacaatcaggtaatagaataaaacgatcgataactatttaatcgatcgtttatatcgatcgttatgctaataataacacccgttagcaatgtatgcagacacacagacatgagattcagggaacaacagagccacacgtcagaaacttccatcagccggatctgcggcactgtaacccttcacctgcaggtatccacatttgtggataccggctttttattcaccctcactctgataaggaaatgctgatgaaacgacatctgaataccagctacaggctggtatggaatcacattacaggcgctttcgtggttgcctccgaactggcccgtgcacgggggaaacgcgccggtgtggcggttgcactgtctcttgccgctgccacgtcactcccggcgctggctgctgactctgttgtaccggcaggagaaaccgtgaacggtggaacgctgataaatcacgaccgccagtttgtctcaggtacggctgatggaatgactgtcagcaccggactggagctgggggcggactctgataacaacaccggcggtcagcagatagcccggggtggaacagccagaaacaccagagtcaccgcaaacggtctacaggatgtcatggcaggtggcagtacctcggatacggttatcagtaccgggggagggcagaatttgcgtgggaaggcttccggtactgtccttaacggcggtgatcaatggatacatgcaggcggcagggcatccggaacggtgattaaccaggatggttaccagaccattaaacatggcggactggtaaccggaaccatcgtcaacaccggtgcagaaggtggtccggattctgaaaatgtgtccaccggtcagatggtcggggggattgctgaatccaccaccataaacaaaaatggccggcaggttatctggtcttcggggatagcccgggacactctcatttacacaggaggtgaccagacggtacacggagaggcacataacacccgactggagggagggaaccagtatgtgcacaagtatggacttgcactgaacacggtaattaacgaggggggctggcaggttgttaaggccggtggtactgccggtaacaccaccataaatcagaacggcgagctgagggttcatgccggcggtgaagcgtctgatgtcacccagaacacgggaggtgcactggttaccagcactgctgcaactgtcaccggtacaaaccgcctgggagcattctctgttgtggagggtaaagctgataatgtcgtactggaaaatggcggacgtctggatgtgctgagcggacacacagccaccagaacccttgtggatgatggcggaacgctggatgtccgcaacggtggtaccgccactgccgtatccatgggaaatggcggggtactgctggccgattccggggccgctgtcagtggtacccggagcgacggaacggcattccgtatcgggggcggtcaggcggatgccctgatgctggaaaaaggcagttcattcacgctgaacgccggtgatacggccacggataccacggtaaatggcggactgttcactgccagagggggctcgctggcgggcaccaccacgctgaataacggtgccacgtttacccttgccgggaagacggtgaacaacgataccctgaccatccgtgaaggtgatgcactcctgcagggaggcgctctcaccggtaacggcagggtggaaaaatcaggaagtggcacactcactgtcagcaacaccacactcacccagaaagccgtcaacctgaatgaaggcacgctgacgctgaacgacagtaccgtcaccacggatatcatcgctcatcgcggcacggccctgaagctgaccggcagcacagtgctgaacggtgccattgaccccacgaatgtcaccctgacatccggtgccacctggaatatccccgataacgccacggttcagtcggtggtggatgacctcagccatgccggacagattcatttcacctccgcccgcacagggaagttcgttccgacaactctgcaggtgaaaaacctgaacgggcagaatggcaccatcagcctgcgtgtacgcccggatatggcgcagaacaatgctgacagactggtcattgacggtggcagagcaaccggaaaaaccatcctgaatctggtgaacgccggcaacagtggtacgggtctggcgaccaccggtaagggtattcaggtggttgaggccattaacggtgccaccacggaggaaggggcttttgtccaggggaatatgctgcaggccggggcctttaactacaccctcaaccgggacagtgatgagagctggtatctgcgcagtgaagaacgttatcgtgctgaagtccccctgtacgcctccatgctgacacaggcaatggactatgaccggattctggcaggctcccgcagccatcagaccggtgtaaacggtgaaaataacagcgtccgtctcagcattcagggcggccatctcggtcacgataacaacggcggtattgcccgtggggccacgccggaaagcagcggcagctatggcttcgtccgtctggagggtgacctgctcagaacagaggtcgccggtatgtcactgacgacaggagtgtatggtgctgcaggccattcttccgttgatgttaaggatgatgacggctcccgcgccggcacggtccgggatgatgccggcagcctgggcggatatatgaacctgacacacacctcctccggcctgtgggctgacattgtggcacagggaacccgccacagcatgaaagcgtcatcggacaataacgacttccgcgcacggggccggggctggctgggctcactggaaaccggtctgcccttcagtatcactgacaacctgatgctggagccacggctgcagtacacctggcaggggctttcgctggatgacggtaaggacaacgccggttatgtgaagttcgggcatggcagtgcacagcatgtgcgtgccggtttccgtctgggcagccacaacgatatgacctttggtgaaggcacctcatcccgtgcccccctgcgtgacagtgcaaaacacagtgtgcgtgaactgccggtgaactggtgggtacagccttccgttatccgcaccttcagctcccggggtgatatgcgtgtggggacctccaccgcaggcagcgggatgacgttctctccctcacagaatggcacttcactggatctgcaggccggactggaagcccgtgtccgggaaaatatcaccctgggcgttcaggccggttatgcccacagcatcaacggcagcagcgctgaaggttataacagtcaggccacactgaatgtgaccttctgataattctgcattgcctctctgtggtcccggtcatcatgaccgggacccggacgggggaaaacgtttcagtgccacattcactgacattcacaataacatgatattcatcacggagtgactatgttacagatagtcggcgcgctgattctgctgatcgcaggatttgccattcttcgccttttgttcagagcattaaccagcacagcgtctgcgctggcagggttcatattgctgtgtctgttcggtccggctttactggctggctatatcactgaacgcataacccggttattccatattcgctggctggcaggcgtatttctgacgattgccggaatgatcatcagcttcatgtggggacttgatggtaaacatatcgcactggaggctcatacttttgactctgtaaaatttattctgaccaccgctctcgccgctggtctgctggctcttcccgtgcagataagaaccattcagcagaacgggctcacacctgaagatatcagcaaggaaattaacgggtattactgctgtttttatactgcttttttccttatggcgtgttctgcatacgcaccattgatcgcattgcagttcgatatttcaccctcactgatgtggtggggcgggttgttgtactggctggctgcattagtgacgctgctatgggcggccagccagatccaggcgctgaaaagactgaccagtgccatcagccagacactggaagaacaaccggtgctcaacagtaaatcgtggctgagcagtttgcaaaacgattacagccttcctgaaacgctgacggagcgcatctggctgacactcatttcacaacggatttcccggggagaactgagggaatttgaactggcagacggaaactggctactggacaatgcctggtatgaaagaaacatggcgggtttcaacgaaaagctgagagagagcctgtcatttacccctgatgaactgaaaaccctcttccggaaccgcctgaatttatcaccggaagcgaatgacgattttctcgatcgttgcctggacggcggtgactggtaccccttttcagaaggccgccgttttgtatcattccaccacgtggatgagcttcgtatctgtgcctcctgcgggctgacagaagtacatcatgccccggaaaatcataagccggatccggaatggtactgctcctctctttgtcgcgaaacagaaacactgtgtcaggacatttatgaacgttctcacaccggttttatttccgatgcaacggcgaatggtctgattctcatgaaactgccggaaacctggagtacaaatgagaaaatgtttgcttccggagggcagggacatgggtttgccgctgaacggggaaaccatattgtcgacagagtccgtctgaaaaacgcacggatcctcggtgataataatgccagaaatggagcagacagactggtcagcggaacagaaatccagacgaaatattgttcaactgcagtccgtagcgtcggtgcggcattcgacggacaaaacggacagtatcgttacatgggaaatcatggtcccatgcaactggaagtcccccgtgatcagtatgccggcgctgtggaaaccatgaagaataagatccgcgaaggtaaagtacccggtgtaaccgatcccgcagaagcgtcccggctgattcgtcggggacatctgacttatacccaggcccgtaatatcacccggttcgggaccatcgaatcggtcacttatgatattgccgaggggtcggttgtcagtctggcggccggagggatcagttttgccctgacggcatcggtcttctggctcagcaccggcgatcgcgatgctgccctgcagacagctgctgtccaggcaggaaaaaccttcacccgcacactggctgtctacgtcacaacccagcaacttcaccggctcagtgttgttcagggtatgctgaagcatattgatttttcgacggccagcccgactgtccggcaggcgcttcagaaggggaccggtgcaggaaatatcagtgccctgaacaaagtgatgaagggtacgctggtgacatctctggcactggtagctgtcacaaccggccctgacatgatcaaaatgttgcggggacggatctccggtgcgcagttcatcaggaatcttgccgtggcatcttccggtgtggcaggtggagctgtcgggtcagtggcgggcgggatattgttcagtccactgggaccatttggtgcactgacagggcgtgtggttggtggtgttctggggggaatgattgcctccgctgtatcaggaaaaattgccggagcgctggttgaagaagatcgcgtcaaaattctggcaatgattcaggagcaggtgacatggcttgccggcagtttcctgctgaccggacatgagattgaaaatctgaacgcgaatctggcccgtgttatcgatcagaatgctctggagatcattttcgccgccggtatacaacaacgggccgcgaccaacatgttaatcaaaccactggtggtcagtatcatcaggcaacgccccgtcatggaatatgatgcatcccatctcggcaatatggttaaccgactggaagaaacattacccccggagttaccggcataacggctattctgcgccttttacgttttatcacctgatttgtcagtgtcatcgtcatgactcagagaggtaaataccatgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcctttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaatgttaactgatccctgaagtcagtttcatgcttcagcctctgccacaacgtatggcagaggctatttatcaggagaaaccagatatgccgggttacacacagagtatgtcctggctgaaggatctttctcatacgggcaggcggttgctgtcataaccgcttaccacaatgtgtttatccaggatgacccgggaatgcatttccgtcgggttatccgcaacgcggaaggtcagcgacgctgacgcagccggaactctgaagctgatgccggaaaacagcttaatgcgtggctcgccagtggagggcttctcagacaataaacctcattgatttcatccatcaggccgcgtcttctccgggagacgcggcttttttcatttattgcaccagtaaatcttaaccaccgataaggagcaaagtatgcgattagccagtcgttttggttatactgcaaaccagatacgtcgtgaccgtccactgacacatgaagagctgatgcaccatgtgccggggattttcggggaagagaaacacacgtcccgaagccagaactatacgtacatccccaccatcaccgtactggaaagcctgcagcgggaaggctttcagccattcttcgcctgccagacccgtgtgcgcgacccgggccgccggggatacaccaaacacatgctgcgtctgcggcgggccggagagataaacggagagcatgtccctgaaattattctgctcaactctcatgacggtacctccagctaccagatgctgccgggttacttcaggttcgtctgccagaacggctgcgtctgtggtcagtctctgggggaagtgcgtgttccacaccggggagacgtagtggagaaagttattgaaggggcttacgaggtggtgggcgtgtttgaccggatagaggagaagcgtgatgccatgcagtcgctggtcctgccgccaccggcacgccaggcgctggcacaggcggcactgacttaccgttatggtgacgaacatcagcccgtcaccaccgccgacattctgacgccacgacgccgggaggattacggtaaggacctgtggagtgcttatcagaccatccaggagaatatgctgaaaggcgggatttccggtcgcagtgcaaaaggaaaacgtatccatacccgggccattcacagcattgataccgacattaagctcaaccgtgcattgtgggtgatggcagaaacgatgctggagagcctgcgctgatgcaatctgtccctgaaggcgtgattcaggcaccagaatcacccgacgccccggagagctcagtctgtgcagactgagtacaggcaatggcatctggccatccgtctgtgaccggaacggttacgcgtacggctgtccggaatttcagccgaatatcattcatccctgacattaccgggtctcacggtcagtgatgaacgtgatgttgtcagcccccggcctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgggtcttcggctggatggaccgtctgtatgaagactactgcggtggtatctggaatctgtacaccctgaacaacggtggcgcatttatggcacccgaaccggatgacgatgatgacgaaacatgggtgctgtttaacgtcatgaacggtaaccgcgctgaaatgagcccggaagccgccggcattgccgcctgtctgatgacgtacagtcatcacgcctgccgtacggagtgttatgccatgacggttcattattaccgtctgcgggattacgccctgcagcatccggaatgcagcgccattatgcgcattattgactgaaagggggcaggaacaatgcaacagatttcctttctgcccggagaaatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggttttctcctttgccgaacatggtctgctttaacccgtcacaaccacatcacacctgttttcacttttatcttctgtcttcagaggtatcccattatgaaaatcatcacccgtggtgaagccatgcgtattcaccaacagcatcctgcatcccgtctttttccgttctgtaccggcaaataccgctggcacggcagcactgaagcgtataccggtcgtgaagtgcaggatattcccggtgtgttggccgtgtttgctgaacgtcgtaaggacagttttggcccgtatgtccggctgatgagcgtcaccctgaactgaatcaggacgggcattcagatgagcagcattatcaccatcacagtgtatacgctggatgaactttcctgcccggcacggggaaaagcccgcgactggtaccgtcagcatcatgctgacagcaactggtatgaaaacgtgtatgaagacttcagggaggtctgtggcattttcgggattgacctccgccagcgcgttttccggctcagcaatggcaggtttatggaagagccgtgcatctggttcagcggattctgcagccagggggacggagcctgttttgaagggcgctggcactggcagccagcgacaccccggaaaatcagggaatatgcccctcaggaccgtgagcttcatcgtatcgcggataccctgcaggcggtgcagaaacgtaacttctggcagcttcaggctgaaatcagtcaccggggacgttactgccatccgtacagcatggatatcaccgtcacccggaacagtccgactggtcaggcaatgacaaccgatgcggaagccgctgtcagcgaagccctgcgcgacctggccttctggttgtaccgtcaactggaaaacgagtacgactggctgacctcagacgccgctgtggatgaggccctgctcatcaacgaatacaccttcaccgaagccggtctgtgcaccggctgacccgtcatcgttaaactatcattcaccgattttctgtgaggactttatcgtgtcagacacgctccatgaaacaaattatcccgacgacaacaacgaccgcccctggtgggggctaccctgcaccgtgacgccctgtttcggggcacgtctggtgcaggagggcaatcagttgcattaccttgccgaccgcgccggtatcagagggcagttcagcgacgcggatgcataccatctggaccaggcttttccactgctgatgaaacaactggaactcatgctcaccagcggtgaactgaatccccgccatcagcataccgtcacgctgtatgccagagggctgacctgcgaagccgacaccctcggcagctgtggttacgtttatatggctgtttatccgacactggcacccgcaaccacctcataaccccgaatatctcacctttagcactaccagttacagagaacttaagatgaaaacattacctgacacacacgtacgggaggcatcgcgctgcccgtctcccgtcaccatctggcagacactgctcacccgactgttggaccagcattacggcctcacactgaatgacacaccgttcgctgatgaacgtgtgattgagcagcatattgaggcagggatttcactgtgtgacgcggtgaactttctcgttgaaaaatacgcgctggtacgaactgaccagccgggattcagcgcaggagtcccgtcgcagttaatcaacagcatcgatattctccgggcccgccgggcaaccggcctgatgacccgcgacaattacagaacggtaaatgacattaccctgggcaggcatccggaggaggcgaaacaatgaacctttccctgacgccggaggccgacggcattaacgtacaggcgatgaacatggggcgcattgtcgttgacgtcgatggtgttaattttgctgaactgattaacgtggcctgcggcaatggctactcccttcgtgttgttgatgaatctgaccggaccgcaactgacagcatgccaccctccgctgccctgagcggtatacgctgcagcacctcacatatcacggaaacagacaacgcttggctgtactcgctgtcgcatcagacgaatgacaccggcgaatcagaatggattcattttacaggcagcggatatctgttacgtaccgatgcgtggtcatacccggttctgcggcttaaacgcctgggcctgtcaagaacgttccgtcgtctggtcgtcactctcacccggcgttatggcgtcagtctcattcatctggacgccggcgcagaatgtctgccgggtttacccactttcgactggtaatcaggacaaaagacactggatgaaattattaaccacagaaacggcgctggatattctgattgcgtggctgcaggacaatattgactgcgaatcagggattatcttcgacaacgatgaggataaaacggattcggcagcactgttgccctgtattgaacaggctagggaggatatccgtatcctgcgccaactgcagtttctgcaacaaaaccggtgagtctcactcaccatacttcattccactgacgccagcctgaacagggctggcgttttcatttatctgcgaaaaggaatatcgattatgtctgcaatcacagtctcccgtccggaagtggtcaacgggcatacggacgttatctgctcaaccagtatccgccacattctggctgtacgaaagagtacactgctgcaaatcgacacacttatccggcaactggctgaaatctcatcaatgacagaaagtattggcggtaaaaccgcactggactgggccatgaaacaggattttcgctgtggttgctggctgactgagaaaccggaaaccgcaatgaaagccattacccgcaaccttgaccgtgaaatctggcgtgacctgatgcaacgctccgggatgctgtcattaatggatgcgcagacccgtgatacatggtaccgatcactggagtacgataattttccggaaatcagtgaagagaatattctgagtacgtttgagcagctacaccagaataaggatgaagtgtttgagcgaggagtgatcaacctcttcagagggttgagctggaattacaaaaccaattgcccctgtaaatttggcaataaaattatcgtcaacaatctggtgaggtgggaccggtggggattgcatcttatcaccgggcaacaggcagatagacttgccgacctggaaagaatgctgcatctgttcagcggcaaaccgatccccgacaacagggaaaacataactattcatctggacgatcacatccggtctcttcagggaaaagaatgctatgaagatgagatgttcattattaaatactttaagaagggctctgcgcacatcacgttcaggaagccagaactggttgacagactgaatgatattatcgcaagaacactatcctgacatgctggcagtatagctttgccagtatgctcaaagctcggaaattgtccgataagatatgatcgtggggcatataaaccggtttcagatggcatacccggtggcatactgtctggaaggataaataaaaaagcgcatgttaaacaataacatgcgcttgtaatctggcggtgagggggggattcgaacccccgatacgttgccgtatacacactttccaggcgtgctccttcagccactcggacacctcaccaaattgtcgttcctgtct

SEQ ID NO: 13 - DNA, 96457 bp, Escherichia coli
  Nissle 1917, Genomic Island II
  ref <308>: DATABASE ACCESSION NUMBER: AJ586888
  ref <309>: DATABASE ENTRY DATE: 2005-04-15
gcccggatagctcagtcggtagagcaggggattgaaaatccccgtgtccttggttcgattccgagtccgggcaccaaattcatataaacggacctccacggaggtccgtttttcgtttcagaacgccacaatttaagcgttctgcctccaaatcaattctaccgaactcaaccagattccccccacatcaaccccattgtgtgggtataattgcgggtataccccagttcgacagaatttgtaccctctttaacgcattcagaaggctgaactatggcactgactgacgcaaaaatccgggctgcaaagcccactgacaaggcttataaactcactgacggggctggcatgttcctgctggtacatcctaatggttcccgttactggcgtctccgttatcgtattctgggtaaggagaaaaccctggcacttggtgtgtatccggaagtttctctctccgaagctcgtacaaaacgggatgaggcccgaaaactgatttcggagggggttgacccttgcgaacagaaaagagctaaaaaagtagtccctgatttacagctctcttttgaacatattgcacgacgctggcatgccagtaataaacaatgggcacaatcacacagcgataaagtactcaaaagcctcgagactcacgttttcccctttatcggcaaccgggatatcacaacactcagtaccccggatctgcttatccctgttcgtgctgcagaagttaaacaaatttatgaaatcgccagtcgtctgcagcaaagaatatctgctgtaatgcgttatgccgtacagtctggcatcatcagatataacccggctctggatatggctggtgcattgaccacggtaaaacgccagcatcgccctgctctggatctttcacgcctgcctgaacttctgtcgcgtattgacggttataaaggccagcctgtcacccgactggcagttatgctgaatttactggtttttattcgttccagtgaactcagatatgcccgctggtctgaaattgatattgacaatgccatgtggactattccagccgaacgcgaacctctgccaggcgtaaaattttcataccggggctccaagatgcgaacaccacatcttgtgccactcagccaacaggctgtagccatactggcagaacttcagacatgggcaggtgaaaatggtctgatctttacgggagcacacgacccacgtaaaccaatcagtgaaaataccgtaaataaggccctcagagtgatggggtatgacacaaccaaggaagtctgtggccatggattccgggcgatggcgtgcagtgcattgattgaatccggcttatggtcaagagatgcggttgaacgtcagatgagtcatcaggagcgcaacggagtacgtgccgcgtatattcataaagcagaacatctggaagaacgtcggcttatgctgcaatggtgggcagattttctggatgcaaacaggggggagtgtatcagtccgtttgaatatgcaaaagttaacaatccactgaaaaggtgactgaacgccatttacacacatgctcttcctcttaaggggaagagcacccgcctcaatcaatttcttttttatgccggcggaaccatcagccaggctgaggttctcattcaataactcaacgtcttaccacagaacagaattcactgtattatcatgggcaacgttaatcccggacaataaaaggacaccgatgccaggcatcacaatttttatagcctgcaggttatggtccatccttttttacaggttcagaatatgactggcaaattacgctttgaagtgaacgataaccagggctgtttcatatttccggaaacctggtttggctcgttgctggatgagtttgaagaactgattgatgcatacgatgcggatgaaatcagcgaaacaagttacatcaacaaactcaggcgccttgcccgacaggagaatgactttattgatgtacacgctcacttggcatacgtatttctggagcagaatgccccgcgtaaggcgctgaatgctgcccttaaagggctggcaattggcaatcgtcttatccctgaaggtttcagtggcagaatcatctggatacatcctgacaaccgaccttttcttcgtgccctctatgcggcaatcctggcaaatgcacatttacagcgtcatcaggatgccatcatgctcattgaaaaaatactggattacaatcccgaagataatcatggtgcacgctggctactgggaccggaactgttacgcactggcgctcatgaacaggcacgccatatactgcaggaacatgcagatgaattttcaccttactggtatgaactcggccttctgcattttcttaatggggaactggtaaaagctgcaactgcatttcgtcgcggctttgcggcaaatacttacatcgcagaaatactgtgcggaaatctgcatccatttccacttgctgtatggcataacttttcaggcggtccggatactgccgaagattattatgccacataccacccgttatgggggcaatatccggaagcattgctgtttgtaaactggctctataatcattcctctgtgctgcatgaacgggcagaaatcattaaatgcgccgaaatgctgatgcaggaagatgatttcgaaatatgcgaaagtattttaagacagcaggagaagttgcgtgaaagaattgatgagacgctttctgagaaaattgtacagaaatgcagaaatatgaatggtgaatatatctggccctggatattgccgttttcagcggcaggcatgaaacatactggcatacagtatcagtagatattgcattagtgtatcctgcacacaagtaataatttattcaccaataataacactgttaatgcccccttcccctggttgtcagccaggggttatcttctgaatatttcttttgaaaaggataacacagtaaattatttttatgaattatcccatggactcattaacaccctttcatgatgctttattgtcaaacacgttatggctgacatcaaaaaaaaccggatttcctctgccagcgggtaatcaccttcccggtgttttcggttggtctggttactcctgtctggttattagcaagataattgctataaacagtggaaaactcatcgtacataatctggtgatgaacattacgcttattttcccttgaccggaagaatcagaggctgtggtttcagactgtctgccagtacattcctctctccgttaaaaaccataacgggttcattatcttcgtctgtcagcagattgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatgggcgaacagtggggctatgtcggggctaaatcgcgccagcgctggctgttttacgcgtatgacaggctccggaagacggttgttgcgcacgtattcggtgaacgcacgatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccgacattgtcaagatgaacagcatgcattgtaacagtctgcagtttatgttctccgtggataattattcttatttcatggtgatttttgttatattttaaaatgcatatctcaccatttagtttttatatcacaaaaacatagtaatgcaatcatacacacctgcctctatcgtacagagaaaacgggcaattatttgtattattccttcataacgacttcagtatacaggatgaccgcaaccacgctccttctcctgcccgggcgaagtgcctggttcagacaattacattaactggctgaaattttcgacgcggtacaggcctccctgctttgaaaggtggcctggcgctgcaattttttacttttgtttttgtatccggaaaaacacatctgcaagaatcattattctcttgcctgaagctatccagcatcctcagatatttcgcactttatgagctggcatcagaaaaatgtgccagtaactttttattaatgacttcaaacagttcctgttcatcatgggtcagataatcccagatttctttcagatacatgctttgtgcaagagtgagcctctgaataaaaaacataccttcagatgtcagactgatttttttagcacggcgatcctccctgctatccgtcctttttacatatccggctttttctaaaaaatctgtaatgcgggtaatattagttctggtaaactgaagtttctggcttatctctgaaggtgacagacaatggttctccgctgcgaataatgtggtgagaaccatatatgctgagtgatttattccatacacccccagaaattcagatatattatcctgcattcttttatttgtgcgaatacagagctgcatcaacaaatgttcccgaaagggatatgcggggtcctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctgagtgatttattccatacacccccagaaattcagatatattatcctgcattcttttatttgtgcgaatacagagctgcatcaacaaatgttcccgaaagggatatgcggggtctttgtttttttggtgtctgattattttttctaatgtgtctgtgttattcatttcattattctccatattactgaaacacactgtctgtgtacaagcgcgcatcagtcatccggtaaacatcgactttccactacaatttattcctacctgatttctgtatgacagagtagtcccgacaggcagacggataaattcccgcaggtaaaagaacataaatgctggctgctgacaagtctgtgaaaaaggattattgtagtggttcacaaaatcaggacaccggaataacctgtttccacttttcttcatgtaagcaaggcggtaaaccatcgttgttcgtgtgaggtcgataaacgttgtaggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatcgtgcgttcaccgaatacgtgcgcaacaaccgtcttccggagcctgtcatacgcgtaaaacagccagcgctggcgcgatttagccccgacatagccccactgttcgcccatttccgcgcagacgatgacgtcactgcccggctgtatgcgcgaggttaccgactgcggcctgagttttttaagtgacgtaaaatcgtgttgaggccaacgcccataatgcgggctgttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcaccggttgcgactgcagaaaaagcaccctcagtgacttgggcattattggctgacgacttcttaacaatcgcagtataatgcagcacattatcaccatctttcagggtattagcatcaccttctgtgccatcgaaagaaacgtttttacctgcagcctgaactacaatcgcagtacctgtccccccgctggtatctaactcctcattatgaccagaaacccttggaccactaaaagccagcttcacagtccctttttttgctgccgagactcctccccccccttaaatgaagtgatatcacaattaaccaattcaatatctaaattcattggtttggatacgcctcctgcttgaaggaagctttttgaaagctgtccaaaatcaatagactgatcagctgatttctgagaaatgctgcatggagcatcaacaacagttccgttaaaggttactctaccctgcccctgtggagtagttagagcagcatttacaccaaaagacaccactgccatagctaccgcaccggcaataaccgacttaatcataaataacaacctctttttcattactgaacacaccagagatatctggcaatttaaaatgacccgattacctttaataaccagatcaatacaaataatattctcgtattttcagggcaggttatttatcgacagaatactgatataacctgtctgctttctgacaagggcttctttttttatcttccagaaactccggaatgccataatttagtcaaatgccgatgactcatctgtataataaggtgcaagccttgctgcaagagcattcagccgtataagtctccccagtgttgtactgaaatacccattattcatctggtatttctcgcagacctccttacgggagtgcccacctaccagatagtccttcatagccagaatgaccctgtcactgtgaatagaagaaatacctatcagtaaaaaaaatgcatttcagacatagagccgagcaacagcacgctctcgcgtatattcagcaaaaacgcatttcctgaccgactgatgacttcatgatgcgccatgtttcccccttctgtcgggcccctggatatatgcttccggcccggaaatactcttcacgcaataagttaaatttagttttttatgttgtaaatattgatttaaacgatcttttaacccacaaaacaaaattaaaccagaataaaattctaacaacaagaatacactcagataaaaacatcatggtgaattgaatttacagcataaaagatcgtctaaatgcatttttacggactttcttttcacagaaaaataacacacaaaatgtgatacacatcaaataaagccaacaaaaagcaaattcactaaattgcacaaataaagcaaacacagagaataaaaatacctttccgttgataacagagagcatgatttttattattcgaagaaactttgttacagtgagatgagtgaatatatgaagaatgaaatactggaatttctgaacaggcataatggagggaaaaccgcagaaattgcggaggcgctggcggtaacggattatcaggcacgctattacctgttattactggaaaaagaaggtgtggttcagcgctctccattaaggcgaggcatggcaacatactggcttctgaaaggagagaagcaggcggggcagaactgttcttccacaacttaataactcaatctgtgggcatgcttcactgaaacagataaaagttacatcagagtgcagattcaattttgcagcattcatcacaaaatagaaatttagtattttatgtcagaatacttcacatgataataaaaacctgtctggatttactgcatggccagacattacaaaatacaaacgccataaacttcattcagccttcttgctgtccggtaacggaggctgctttttcgttacacctttccccggcagcatcagtagcagtaatttatagattctacgaactgagactgtctgtccggggagaacgtacacagcccgacacaatgtaccagtcaataatatccggtttctgattccctgcctgacagaccactctctggcaactttgtattcagttcatctactactggagacagatttataaaatccaactccacgatctttgaccgtccgcatcccctactctctgtgctgcggtcatcggttaattccagcgtccgtccgttacgatcagatattactgaacctccccgggtttcctggagagtgttttatctgtgaactcaggctgccagatcattgtttccgatggaagcataataagctttttctgcttctgccggaggagtatggcccagccttcccagcaatcatcgattgttataccagtccacccacgtgagtgtggccagttccacttctgcacggtttttccagctcttacggtgtattacctccgctttgtaaagaccattgatgctctccgccatcgcgttgtcatacgagtcgcctgtactccctgttgatgccagcagttttgcttcttttaatcgctccatataggccagtgacacatactgagagcctttatcgctgtgatggatggtgccggacggacggcgggcccacaacgcctgctccagcgcatccagcacgaatgtcgtttccatagacgatgagacccaccaccccacgatgtatccggcaaacacatcaatgatgaacgccacatagacgaagccctgccatgtgctgacgtaagtaaaatcagccacccacagctggtcaggacgttctgccacgaactgacggtttacgcggtcacctgcagcaacggttttccggctgacggtagtgcggacctttttaccccggagaacaccggcaagtcccataaccgccatgaggcgcgccactgtacatctggccaccctgattccttcccgtaacaactgacgccagactttacgcacaccgtacacctgatgattttcatcgtatacgcgctgtatctctctcttcagccagtcatcgcgctgacaacgggcactgcgtttatcaggatgatgccgctgctgctgacaatggtaatacgttgacggggcaatatgctgttcactgcataccggtccgaccccgtactgctcacgcagcttatccagcagtggcattattttttccagaggcggtcgaactccgccttcgcaaaataagcggaagcctggcgaaggatatcgttactgcggcgcagttcacgattttcacgttccagctctttcagacgctgacgttcagcggtggtgagcccaccatcaccgcccccggtatcccgctcatgctggcgaacccagacacgcagagtctctggcgtacagccaatctttggagctatggaacaaattgccgcccattgtgagtcatattcgtcctgactttccagaaccatacgaactgcccgttgacggacttcgggggaaaaacgtgtatttttagtcatcctgtttacctctttctcagggaatttagtctccaggattcccggggcggttcacagtaatcatgccgggtctggctggctaacaccccattataaggggtacgaataaagtaacggggcttcacgcagggatggacagattgctctgatatacagccgacgacgtcccgctgcaacatcatcacgcagatgcttcattttcagatttgggacctccttttgatttctcgtttaacttttgctgttaccagactttaatctattttaacaattcaagaattttttataaaatgctcaaagatgaaagcgttactgaaccaaccagcttggctgatgttttctatagataaaaagatcatcagcaaaaactgatagcctgaatcacctttactaccaatcatgtatgaagaaaacacgcacaaacaattgacaatgattatcatttgcattaaaaggattatgtagtatttttatttcatgaggaactatacccgccagcaatctgagtagcgaaagctgttcatccccaatatttttgctggcgggttcttttttctactgcccttctcctcagagggagcattccattctttttttcattaatggcgagggggcgggacaaaaagccggttctttatccctaaataacagcatgatttcagtccatgcaaaatctgatttaccagctcacataataacctgatgatacatgggttttccctgatcatggtgggaaggctcagaacgccatattcagtttcccgtagtggaacatcacgcccagcttaaagcgctcccgatttcggtatcccctggcttttatcctcagtagcctgatcttactgttaagcgcctccgcgtttccgtttgagacacggtgtcgcatggcattcaggatcccgtaaagcctttttcctatcgttttcgcggcgtttttcatcataggaacgtcactgttggccgccagagccagccatctctcccagtcattacgtctttcctcactccatggcctgttccagatatcctttgccagctctttcagcgcccagcactggcttgtcagcttcatctgtgcacgcagccatatcagcttttcctgcctggatttggtcatccatttatcgctgtactgccacaggaagcgggtcccctttgcctgacgccaactttcaacagggaggtgcggatgttcattctgacgggttttatcaaccacttcgccaagttgctttgctacatggaagcggtcgaaggcgattttctcaaccgcacagggtaagtggatacgcgctgctcttatatagcctgcattcatgtccattgagagcgttttgatagccagcaactgcccgtcagtaagcgtgcgaagatagccggcgaggctctctgtgccacgatcgtccgttaaggccagcgcacgaccatcgcgatcggagatcaccgttatataacgatgtccttttttaaaggcgacctcatccacattgtcagcaccagtgatataagacggatagcaaagcgcacgcgctgtttgtcaccgtgaaaaacgacggtgcgacggcaaaagccaataacaacgagagcgtcgtgcgcattcctctgcactgacagttgattcttagaacgtagaggcctggattgctgccaggcttttattgcactaccagctacggctaaaagataagcgtcccgggaagtacatagcgcttacaaaatatccgacatgaagcatactggaaacgaggcgtattgttattgttgttcatattggcttccgtggcggaaatatcagggggtagctacatatcccccatgcagccaaggcaacgatgttaactctcgtcacctgttcctttcgacagagccaacctcgcagagggccagatcttacaacttcacctcagtgatacaaaacacaaaaatacaaaacaatttgatacaaatcatccctcttattttaaataaatccatcttgcaagcctaccaatcagaaggtagcatgtgtagtatcgcaaacataaagagaaattgctcatgaattatgttatctgcactaccattgtcgcccttggtctcattctgacaggctacgcaactgctgcagatgaaattaatcgtcaggacgttgttggtttgatgccgtcagactatatttctgttggtaatctatatacaccagaagaggtggcaactgcgcttaaagacaaagcggagcaggcaggaggttctcatttccgaatcacttcattgggaggaaaaaataaacttgatggaactgccattatctatcgctaaaatatgtataatagtccctttaatacataacaggtaaagccgtgtctacttatgagaatatacttcgcataacggatactctgatccagcaacgcggatttttggggttcagttacgcagatctggaaaaagaaattggtatcagaaaagccagtattcatcaccatttcccgaggaaaactgatcttggtatagcctactgccaatacaaaacagaagtatttgatagacttaatataactctccataatgtttcttcaggtgtacaacgtctcaggacatatcttgatgcatttgctggttgtgctgaaagaggggaaatgtgcggtatttatgccatgctatccgacagccatcagttttctcctgaattacaggaggctgtaagtcaactggcacatcaggagatacagatgattaaagatattatcacctccgggcagaatagtggagagttcaaaacagttcttcttccggatgagctcgccgttatagtctgttctacactaaagggggcactgatgttaaatcgacttccaccacatgatatctattcaggaaccgttaacgctttaattaaaatgcttgatacccgtacttaatcctttttagtgcatataattttccacccggagaatgaaatgaaaaaatttattaatgtttacattaaatcagattatgacatagttattcttcgcctgtctgttattataatatttatgctcttcgggacctataaatggtttgattttgaagtgatggccctcaagcccctgatttctcccacgtggctgaatatcctgtacattatgtttggtgttcatggggggagctatttcctcggcatagtagaaactatcacttttctagcactgagtatcggcttcttcaggcctgctgctggcatactgggagatattatcgttattgttacaggtttagtcacactaagtctgttaccacaactgggaaaagttgacagttttgtcatcaaagatgtgctgctgttaggtgctggtagtgtcctgctgaaatatgatttgaaaaattatttaaatatcaaaaactgatttttcacttcggtgatgaacgtttgcgtattttcatggaaagagattacctaatccccctcgttctccttcatgttaatacgcaacgttatggaaaacaaaaataccctgagtaaaaaggtccgtaggcaggcgagtacttttattttccgctagttttactttcccatcgaaggccccatacatcactacgcccacgaaacaaccgacgaaataacgcaactttctcatccgtggataatacggaaacgcactgcacaggactctgcggtttacgtcgccattcaatcccataagcttcaagtgatgtcttccctcagtgctgctaattcatcactgtcagatttatgaaccatattcgttacctgtatccgaaccactgaagcaccacagcagaaattcgggtcccctacactgattacagcgccccctctgctgcctattaactcaagcacctcccaacaacttacggaaacttaattctaatacagctgtaattcagttgtgtcgtggtcggccgcggttacttttttcgggaagtctgctacgcatcagaataataccgtgttctttctgatcctgtttagccaggtagctaagggcgtaacgtaaaccgttagactggccccctgaatctccagacaaccaatatcacttaaataagtgatagtcttaatactagtttttagactagtcattggagaacagatgattgatgtcttagggccggagaaacgcagacggcgtactacacaggaaaagatcgctatcgttcagcagagctttgaaccgggaatgacggtctcccttgttgcccggcaacatggtgtggcagccagccagttatttctctggcgtaagcaataccaggagggaagtcttactgctgtggctgccggagaacaggtcgttcctgcctctgaacttgctgccgccatgaagcagattaaagaactccagcgtctgctcggcaaaaaaacgatggaaaatgaactccttaaagaagccgttgaatatgggcgagcaaaaaagtggatagcgcacgcgcccttattgcccggggatggggagtaagcttcgtcagccgttgtctccgggtgtcgcgtgcgcagttgcacgtcattctcagacgagccgatgactggaaggacggccgccgcagccgtcacacggatgatacggatgtgcttcgccgtatacaccatgttatcggagagctacccacatatggttatcgtcgggtatgggcgctgcttcgcagacaaacagaacttgatggtatgcctgcgatcaatgccaaacgtatttaccggatcatgcgccagaatgcgctgttgcttgagcgaaaaaccgctgtaccgccatcgaaacgggcacataccggcagagtggctgtgaaagaaagtaatcagcgatggtgctctgacgggttcgagttccgctgtgataacggagaaaaactgcgggtcacgttcgcgctggactgctgtgaccgtgaggcactgcactgggcggtcactacgggcggcttcaacagtgaaacagtacaggacgtcatgctgggagcggtggaacgccgcttcggcaacgagcttccggcgtctccagtagagtggctgacggataatggttcatgctaccgggctaatgaaacacggcagtttgcccggatgttggggcttgaaccgaaaaacacggcggtgcggagtccggagagtaacggcatagcagagagcttcgtgaaaacgataaagcgtgactacataagtatcatacccaaaccagacgggttaacggcagcaaagaaccttgcagaggcgttcgagcattataacgaatggcatccgcatagtgcgttgggttatcgctcgccacgggaatatctgcggcagcgggcctgtaatgggttaagtgataacagatgtctggaaatataggggcaaatccaggcgggggcagcaagccagaacactgcctgacatgttttcatcagacgcaggtcctctctcatatcctctgatttactccagtaaggtgatgatcatatctttatttgatagtacggtaatgccagataaatacagacacaatggtaaataatatagttgcaaataatgctgccataatcagcgcgattgcgacacctgttttcgataccagcggcaccagcaaagcgcacagtccatagccaagtgtgtgactggtagcgagccagcccgcgcctgcgccatcagccagcttatcattcagtagaagttgataagcgggtgttgccagagctgctccaaatgacagcactgcacagcccgggtaaaacaaccatagctgttcggagagcatgatagccagaccaccactcatcaacactccggcactcaggagcagggccaccggagtcaggcgctgcggacggagtaccccgaactgcgcgataagcgcagctactgcggacagacccaacagccaggccacctgttggctaatggcggtggtatccgtggcgaactggcgagtaagggcaggcgaaagtccaagctgcatcatgctcaccgccgcagccagtaatattgcgcaaagcagataaggcagacaatcccgcttcagactgacgctcttgcactccggtgtgggctgtggtggtgtgccgggcaaccgcagcagcatcagcagcgccagcactggggctgccatcagcagccccagtggcgccagaggatgaatggccagcattgctgccgcgcacagcggcccgaatagcctgccgcaactcaggccggagctgatggttgccagagcggccatgcgattcccttctccagctctctgcaatgcccagacctgacaggctggcaccattgccgacacggtcagcccgtaggcgatccgggcgatgattaatattcccagtcccaccgctgttgttatggcgctggtagccatcagcacgcttcccagccctagcagggtaaagcttatgccatatcctcccagagcccacaacaccacaggtttactgccagtacgggaaatttgctttccccagcacggggacgatggcagaaacagcattgagccaagcatcagcagggcagcccatacagacagactcagatttgtctgtatgaccagaacagggagcacaaccagcagaccgttctgtccgataccgagaagcccggcactgaacgcaagtggccagcaggacagtggtttttggggcgtatcttcgatccctggtgacattataatgtttcaactccatgtattaattgtgtttatttgtaaaattaatttatctgacaataacatttattattgataatgagaatcattattgacataattgttattattttgctgtgtgggagctgtttgactatgaccctgccctctgaaaaaccagccacagatgtggctgcgcagtgcttcctgaatgcactgattcgtgaaaccacagactggaaactgacagaatacccgccagacgaattgctcatcccgctggatgagcagaaatcgctccatttcagagtggcttatttctccccaacccagcatcaccgctttgcatttcctgcacgtctggtcacggcatcaggcagttatcctgtcgactttaccactctctcccggcttattattgataagctacgccatcaactgtttctgcccgttcccctctgcgaaactttccaccagcgcgtgctggaaagccatgtccatacgcaacaggcaattgatgcccgtcatgactgggccgctctgcgtgaaaaagcgttgaattttggcgaggctgagcaggcgctgctgacaggacacgctttccaccctgcgcctaagtctcatgaaccgtttaaccggcgggaggctgaacgctacctgcctgatatggcaccccacttcccactgcggtggttttcggtggataaaacgcaaatcgccggtgaaagtttgcatctcaaccttcaacagcggctgacgcgatttgccgcagagaatgcgcctcagttactcaacgaattaagtgacaaccaatggctgttcccgttgcacccgtggcagggggaatatcttttgcagcaggggtggtgccaggcacttgttgctaaagggctgattaaagacttaggtgaggccggcacgtcgtggctgccgaccacctcttcccgttccctctactgtgccaccagccgcgatatgatcaagttctccctgagcgtacggctgaccaactccatccgtactctgtccgtgaaagaagtgaagcgtgggatgcgcctggcacgcctggctcaaaccgacggctggcagatgctacaggtccgcttcccgactttccgggtaatgcaggaggatggctgggccgggctgcgcgatcttaacggcaacatcatgcaggaaagtctgtttgccctgcgtgaaaatctgctggtggatcagccgaaaagccagactaacgtactggtctccctgactcaggccgcacctgatggcggtgattcgctgctggtttcggcggtaaaacgcctgagcgatcgcctcggtatcactgtgcaacaggccgcccatgcatgggtcgatgcatactgtcagcaagtgctaaagccgctgtttacggctgaagcggattacggcctggtgctgctggcgcatcagcaaaatattcttgtccagatgcttggggatctgccggtcggatttatttaccgtgactgtcagggcagcgcttttatgcctcacgcgacagactggctcgattctattggcgaggcgcaggcggaaaatattttcacccatgagcagttgctgcgctatttcccttattacctgctggttaactccacttttgctgtgaccgctgcgctgggggctgccgggctggacagcgaatcgaatctgatggctcgtgtacgagcatcgctggctgaagtgcgtgatcaggtgactcataaaacctgtctcaactacgtgctggaaagtccgtactggaacgtaaaaggtaactttttctgttatctgaacgatcataacgagaacaccattgttgacccttcggtgatctatttcgatttcgctaacccgctgcaggctcaggaggtctgaatgtctgaggcaaacattattcacagcagatatggactgcgctgtgaaaaactcgacaagcccctgaatcttggctggggactggacaatagcgcggtgttgcactgtcccggggagctgccgacagggtggctgtgcgatgcgctggatcagatatttatcgccgctccacaactgtcagcagtggctctcccctgggccgaatggcgtgaggagccacaggcgctgacgctttttgggcaggtaaaaagcgacattatccatcgtactgccttctggcagttaccgttatggttgagttcaccggcaaaccgggcctccggtgaaatggtttttgatgcagagcgtgagatttatttcccgcagcgcccaccccgtccacagggtgaggtttaccgccgttacgatccacgtattcgcaggatgctgagtttccgcattgccgatcccgtttctgatgcagaacgtttcacccgctggatgaatgatccgcgcgttgagtatttctgggagcaaagtggctcactggaggtacagaccgcctatctggagcgccagctcaccggtaaacatgcattcccgctgattgggtgcttcgacgatcggccattcagctatttcgaaatctactgggcggcggaagaccgcattggtcgtcactattcgtggcagccctttgaccgtggcctgcatctgctggttggtgaacagcaatggcgcggggcccactatgtgcaaagctggctgcgcgggctgacacattacctgctgctggatgagccccgtacgcagcgcacagtactggagccacgcaccgataacctgcgcctgttccgccatcttgagcctgcgggataccggacaattaaagagttcgacttcccacataagcgctcgcgcatggtgatggcggatcgtcatcacttcttcacggaggtcggtctgtaatgaatcacaaggactgggattttgttaaccgtcggctggtggcaaaaatgttgtctgagatggagtatgagcaggttttccacgcggaatctcagggcgatgaccactactgcattaacctgccgggagcacaatggcgcttcatcgctgaacgtggtatctggggctggctgtggattgatgcccaaacgttgcgctgcacggacgaaccagtactggcgcagacgctgctgatgcagctaaagccggtgctgtcaatgagtgatgccactgttgcagagcatatgcaggatttgtatgccacgctactgggcgacctgcaactgctgaaggcccgtcgcggactgagtgccagtgacctgattaatcttgatgccgatcgtctgcaatgcctgctgagcggtcatcctaaattcgtttttaataaaggtcgccgtggctggggcaaagaggcgctggaacgatatgcgccagagtataccaacaccttcagactgcactggctggcggtaaaacgtgaacatatgatctggcgctgcgataacgatctggatattcagcagttgttgactgccgcaatggatccgcaggagtttacacgcttcagtcaggtctggcaggaaaacggactggatcacaactggctgccgctgccggtacatccgtggcagtggcagcaaaaaatcgctaccgacttcatcgctgattttgccgaaggcaggatggtgtctctcggcgagtttggcgaccagtggctcgcccagcagtcgctgcgtaccctgaccaacgccagtcgccggggcgggctggatatcaagctgccgctgaccatctacaacacctcatgctaccgggggatccctggcagatacatcgctgccggaccactggcttcacgctggctacaacaggtttttgcgaccgacgccaccctagtgcaaagcggcgcagtgatacttggtgaaccggctgcaggctatgtctcccatgaaggctatgccgcgcttgcccgggctccctatcgctaccaggaaatgcttggtgttatctggcgggagaatccgtgccgctggctgaaaccggatgaaagtccggttctgatggcaacactgatggagtgcgacgaaaacaatcagccgctggcaggcgcatatatagaccgctccgggctggacgctgaaacctggcttacgcaactgttccgggtggtcgtggttcctctgtatcacctgctttgccgctacggtgtcgcgcttattgcacatggacaaaatataactctcgccatgaaagagggggttccacagcgtgttctgctgaaagacttccagggcgatatgcgactggtgaaagaagagttccccgaaatggactctttgcctcaggaggttcgtgatgttacatcccgcctgagtgcggactacttaatccatgatttgcagacgggtcacttcgtgacagtactgcgttttatttcgccactgatggttcgtcttggcgtacctgaaaggcgattttatcaactgctggcagcagtgttgagtgattacatgaaaaaacatccacaaatgtcagagcgttttgcgcttttctcacttttcaggccacaaatcattcgcgtggtgctgaacccggtaaaactgacctggcctgatctggatggcggcagccgcatgctgccgaattaccttgaggatctgcaaaatccgctgtggctggtaactcaggaatatgaatcatgaaaaaaagtgtcgattttattggtgtagggacagggccatttaatctcagcattgctgcgttgtcacatcagatcgaagaactggactgtctcttctttgatgaacatcctcatttttcctggcatccgggtatgctggtaccggattgtcatatgcagaccgtctttctgaaagatctggtcagtgctgttgcacctacaaatccctacagttttgttaactatctggtgaagcacaaaaagttctatcgcttccttacaagcagactacgtacagtatcccgtgaagagttttctgactacctccgctgggctgctgaagatatgaataacctgtatttcagtcataccgttgaaaacattgatttcgataaaaaacgtcgattgtttctggtgcaaaccagccagggagaatattttgcccgcaatatctgccttggtacaggaaaacaaccttatttaccaccctgtgtgaagcatatgacacaatcctgtttccatgccagtgaaatgaatcttcgtcggccggaccttagtggaaaacggataaccgtggttggtggaggacagagtggtgcagacctgttccttaatgcattacgcggggaatggggagaagcggcggaaataaactgggtctcccggcgtaataattttaacgcactggatgaggctgcttttgctgatgagtattttacacctgaatatatttcaggcttctccggactggaggaagatattcgccatcagttactggatgagcagaaaatgacatcggatggcatcactgccgattctttactgaccatttatcgtgagttgtaccaccgttttgaagttctgagaaaaccaagaaatatccgtctgctacccagccgctcggtaacaactctggaaagtagtggtcctggctggaagttgctgatggagcatcatctggatcagggcagggagagcctggaaagtgatgtggtgattttcgccacaggttaccgttctgcgttgccacaaatacttccctcactgatgcccctgatcaccatgcacgataagaacacctttaaagtgcgtgatgacttcactctggaatggagtggcccgaaagagaacaacatcttcgtggtcaacgccagtatgcaaacccatggcatcgccgaaccccagctcagcctgatggcatggagatctgcacgtattcttaatcgcgtaatgggacgtgatttattcgatctcagtatgccgcccgccctgattcagtggcgcagcggcacctagggaaaacgcagccggaggctgcttctttaactcgctacacagcatctttgggctgattttttccgcccgtatggaggaataatgatgataagcaaaaagtatacgctttgggctctcaacccactgcttcttaccatgatggcgccagcagtcgctcaacaaaccgatgatgaaacgttcgtggtgtctgccaaccgcagcaatcgcaccgtagcggagatggcgcaaaccacctgggttatcgaaaacgccgaactggaacagcagattcagggcggcaaagagcttaaagacgcactggctcagctgatccctggccttgacgtcagcagccggagccgcaccaactacggtatgaatgtgcgtggccgcccgctggtcgtgctggttgacggcgtgcgtctcaactcttcacgtaccgacagccgacaactggactctatagatccttttaatatcgaccatattgaagtgatctccggtgcgacgtccctgtacggcggcggcagtaccggtggcctgatcaacatcgtgaccaaaaaaggccagccggaaaccatgatggagtttgaggctggcaccaaaagtggctttagcagcagtaaagatcacgatgaacgcattgccggagctgtctccggcggaaatgagcatatctccggacgtctttccgtggcatatcagaaatttggcggctggtttgacggtaacggcgatgccaccttgcttgataacacccagaccggcctgcagtactccgatcggctggacatcatgggaactggtacgctgaacatcgatgaatcccggcagcttcagttgatcacacagtactataaaagccagggcgacgacgattacgggcttaatctcgggaaaggcttctctgccatcagagggaccagcacgccattcgtcagtaacgggctgaattccgaccgtattcccggcactgagcggcatttgatcagcctgcagtactctgacagcgcttttctgggacaggagctggtcggtcaggtttactaccgcgatgagtcgttgcgattctacccgttcccgacggtaaatgcgaacaaacaggtgacggctttctcttcgtcacagcaggacaccgaccagtacggcatgaaactgactctgaacagcaaaccgatggacggctggcaaatcacctgggggctggatgctgatcatgagcgctttacctccaaccagatgttcttcgacctggctcaggcaagcgcttccggagggctgaacaacaagaagatttacaccaccgggcgctatccgtcgtatgacatcaccaacctggcggccttcctgcaatcagactatgacatcaataatctctttaccctcaacggtggcgtacgctatcagtacactgaaaacaagattgatgatttcatcggctacgcgcagcaacggcagattgccgccgggaaggctacatccgccgacgccattcctggcggctcagtcgattacgacaacttcctgttcaacgccggtctgctgatgcacatcaccgaacgccagcaggcatggctcaacttctcccagggcgtggagctgccggacccgggtaaatactatggtcgcggcatctatggtgctgcagtgaacggccatcttcctctaacaaagagtgtgaacgtcagcgacagcaagctggaaggcgtgaaagtcgattcttatgagctgggctggcgctttactggcaataatctgcgcacccaaatcgcggcctactattcgatttctgataagagcgtggtggcgaataaagatctgaccatcagcgtggtggacgacaaacgccgtatttacggcgtggaaggtgcggtggactacctgattcctgatactgactggagtaccggagtgaacttcaacgtgctgaaaactgagtcgaaagtgaacggtacctggcagaaatacgatgtgaagacagcaagcccatcaaaagcgacagcctacattggctgggcaccggacccgtggagtctgcgcgtgcagagcaccacctcctttgacgtgagcgacgcgcagggctacaaggtcgatggctataccaccgtggatctgctcggcagttatcagcttccggtgggtacactcagcttcagcattgaaaacctcttcgaccgtgactacaccactgtctgggggcagcgtgcaccactgtactacagcccgggttacggcccagcgtcactgtacgactacaaaggcaggggccgaacctttggtctgaactactctgtgctgttctgacggggatgcttttgcaacaagggtatgctgtaaacaacatggtccttggtggccatgttgtttacagccagtataatatacagccttaacaagatattccgtctccggaatggactgttcaccactgaataacattatgtctgttttatggatctttgactgaaatttatcgcatatcctcatttcattgtccgtctgaaaactaaccttacaagtaagcgtcgtctcagcaccgtctggcagatcctgaaattcctgagaggatgatctgcgcccaatatcctgagccggaactttgctgcaatgaaggccaacgaaaaatgggggagtatgttatagagtacttgctacagggtaaaaagaggtacctgtcgctggttctccgttcagtttaaccgggagattttctcctgcgcctgtcataaagtccggtaatggagattgttaatacgatggtgcacgatgcattgtcagtgcccggcccggaggatgccccgtagctacatacggatcagggttggcaatatcgaatggcaggctataggctaagttaaagccccatggagtagcacaaaatatgccgcacaaaggaaacggtctgaataacgcagcgatggagaacttcttcggcacactgcaaaatcgcatcgtggtcgatcgctaattcgtcgtgaatcactgaacgatgttccatgcgaacagatattcgatcatatcgaaatattaaacattacccctccccacattgggcaaaaaaaaacaaaaaacgatcaattaacgatcaattagtattgattcacataatctctcatcattaatgagaacattgtcacatatttacaatatagaactgttacttttagcaagctgttagtaaccaaccgttactaataattttaattcttaatactttgttcattcaataaatgagttgagagaatatatgaataaaatatactcccttaaatatagtgctgccactggcggactcattgctgtttctgaattagcgaaaagagtttctggtaaaacaaaccgaaaacttgtagcaacaatgttgtctctggctgttgccggtacagtaaatgcagcaaatattgatatatcaaatgtatgggcgagagactatcttgatcttgcacaaaataaaggtattttccagcccggagcaacagacgtaacaatcactttaaaaaacggagataaattctctttccataatctctcaattccggatttttctggtgcagcagcgagtggcgcagctaccgcaataggaggttcttatagtgttactgttgcacataacaaaaagaaccctcaggccgcagaaactcaggtttacgctcagtcttcttacaaggttgttgacagaagaaattccaatgattttgagattcagaggttaaataaatttgttgtggaaacagtaggtgccaccccggcagagaccaaccctacaacatattctgatgcattagaacgctacggtatagtcacttctgacggttcaaaaaaaatcataggttttcgtgctggctctggaggaacatcatttattaatggtgaatccaaaatctcaacaaattcagcatatagccatgatctgttaagtgctagtctatttgaggtcacccaatgggactcatacggcatgatgatttataaaaatgataaaacatttcgtaatcttgaaatattcggagacagcggctctggagcatacttatatgataacaaactagaaaaatgggtattagtcggaacaacccatggtattgccagcgttaatggtgaccaactgacatggataacaaaatacaatgataaactggttagtgagttaaaagatacctatagtcataaaataaatctgaatggcaataatgtaaccataaaaaacacagatataacattacaccaaaacaatgcagataccactggtactcaagaaaaaataactaaagacaaagatattgtgttcacaaatgggggaaatgtcctgtttaaggataatttggattttggtagcggtggtattatctttgacgaaggccatgaatataacataaacggtcagggatttacatttaaaggagcaggaattgatatcggaaaagaaagcattgtaaactggaatgcattgtattccagtgatgatgttttacacaaaataggccccggtactctgaatgttcaaaaaaaacagggggcaaatataaagataggtgaaggaaatgttattcttaatgaagaaggaacatttaacaatatataccttgcaagcggaaatggtaaggtaatactaaataaagataattcccttggcaatgatcaatatgcggggatattttttactaaacgtggtggcacgctagatttaaatggacacaatcagacttttactagaattgccgccactgacgatggaacaacaataactaactcagatacaacgaaagaagccgttctggcaatcaataacgaagactcctacatatatcatgggaacataaatggcaatataaaactaacgcacaatattaattctcaggataagaaaactaatgcaaaattaattctggatggtagtgtcaacacaaaaaatgatgttgaagtcagtaatgccagtcttaccatgcaaggccatgcaacagagcatgcaatattcagaagcacagcgaatcattgctccctggtatttctttgtggaacggactgggtcaccgttttgaaagaaacagagagttcatataataaaaagttcaattctgatcacaaaagtaataatcagcagacctcatttgatcagccagactggaaaaccggggtgtttaaatttgatacattacacctgaacaatgctgacttttcaatatcacgcaatgccaatgttgaaggaaatatatcagcaaataaatcagctatcacaatcggcgataaaaatgcttacattgataatcttgcagggaaaaatattactaataatggttttgacttcaaacaaactatcagtactaatctatccataggagaaactaaatttacaggtggcatcactgcacataacagtcaaatagccataggtgatcaagctgtagttacacttaatggtgcaacctttctgaataatactcctataagtatagataaaggagcaaaagttatagcacaaaattccatgttcacaacaaaaggtattgatatctccggtgagctgactatgatgggaatccctgaacagaatagtaaaactgtaacgccgggtctccactacgctgctgatggattcaggctgagtggtggaaatgcaaatttcattgccagaaatatggcatctgtcaccggaaatatttatgctgatgatgcagcaaccattactctgggacagcctgaaactgaaacaccgactatatcgtctgcttatcaggcatgggcagagactcttttgtatggctttgataccgcctatcgaggcgcaataacagcccccaaagctacagttagcatgaataatgcgatctggcatctaaatagccagtcatcaattaatcgtctagaaacaaaagacagtatggtgcgttttactggtgataatgggaagtttacaacccttacagtggacaaccttactatagatgacagtgcatttgtgctgcgtgcaaatctggcccaagcagatcagcttgttgtcaataaatcgttgtctggtaaaaacaaccttctgttagtcgacttcattgagaaaaatggaaacagcaacggactgaatatcgatctggtcagcgcaccaaaaggaactgcagtagatgtctttaaagctacgactcggagtattggcttcagtgatgtaacaccggttatcgagcaaaagaacgatacagacaaagcaacatggactctgatcggctataaatctgtggccaacgccgatgcggctaaaaaggcaacattactgatgtcaggcggctataaagccttccttgctgaggtcaacaaccttaacaaacgtatgggtgatctgcgtgacattaacggtgagtccggtgcatgggcccgaatcatgagcggaaccgggtctgccggcggtggattcagtgacaactacacccacgttcaggtcggtgcggataacaaacatgaactcgatggccttgacctcttcaccggggtgaccatgacctataccgacagccatgcaggcagtgatgccttcagtggtgaaacgaagtctgtgggtgccggtctctatgcctctgccatgtttgagtccggagcatatatcgacctcatcggtaagtacgttcaccatgacaacgagtataccgcaactttcgccggccttggcaccagagactacagctcccactcctggtatgccggtgcggaagtcggttaccgttaccatgtaactgactctgcatggattgagccgcaggcggaacttgtttacggtgctgtatccgggaaacagttctcctggaaggaccagggaatgaacctcaccatgaaggataaggactttaatccgctgattgggcgtaccggtgttgatgtgggtaaatccttctcgggtaaggactggaaagtcacagcccgcgccggccttggctaccagtttgacctgtttgccaacggtgaaaccgtactgcgtgatgcgtccggtgagaaacgtatcaaaggtgaaaaagacggtcgtatgctcatgaatgttggtctcaacgctgaaattcgcgataatcttcgcttcggtcttgagtttgagaaatcggcatttggtaaatacaacgtggataacgcgatcaacgccaacttccgttactctttctgataacagcccgggccgcgtttgcggcccttcttctaccggagagaatatgtattaccctgtgacagactatatcgctcttgctctcattattagctttctttttctgacattatttatctgcctgttatgccttaaacatgagcgaataaaaaaagaaactatcaggcaaaaaaatgcacatattctggatcatggctggaatgcaactgaggtagcctgagtttaacggacactccttcctgaaatagaatggcatcagaaggagctaataatgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaactgtagattcaattggtcaacgcaacagttatgtgaaaacatggggttgcggaggttttttgaatgagacgaacatttacagcagaggaaaaagcctctgtttttgaactatggaagaacggaacaggcttcagtgaaatagcgaatatcctgggttcaaaacccggaacgatcttcactatgttaagggatactggcggcataaaaccccatgagcgtaagcgggctgtagctcacctgacactgtctgagcgcgaggagatacgagctggtttgtcagccaaaatgagcattcgtgcgatagctactgcgctgaatcgcagtccttcgacgatctcacgtgaagttcagcgtaatcggggcagacgctattacaaagctgttgatgctaataaccgagccaacagaatggcgaaaaggccaaaaccgtgcttactggatcaaaatttaccattgcgaaagcttgttctggaaaagctggagatgaaatggtctccagagcaaatatcaggatggttaaggcgaacaaaaccacgtcaaaaaacgctgcgaatatcacctgagacaatttataaaacgctgtactttcgtagccgtgaagcgctacaccacctgaatatacagcatctgcgacggtcgcatagccttcgccatggcaggcgtcatacccgcaaaggcgaaagaggtacgattaacatagtgaacggaacaccaattcacgaacgttcccgaaatatcgataacagacgctctctgggacattgggagggcgatttagtctcaggtacaaaaaactctcatatagccacacttgtagaccgaaaatcacgttatacgatcatccttagactcaggggcaaagattctgtctcagtaaatcaggctcttaccgacaaattcctgagtttaccgtcagaactcagaaaatcactgacatgggacagaggaatggaactggccagacatctagaatttactgtcagcaccggcgttaaagtttacttctgcgatcctcagagtccttggcagcggggaacaaatgagaacacaaatgggctaattcggcagtactttcctaaaaagacatgtcttgcccaatatactcaacatgaactagatctggttgctgctcagctaaacaacagaccgagaaagacactgtgaagtggtcaacaaaaactggccaccgagttagagttttttccagtatcgattttccgattcgtttggtggtaacccaccattatattcgtgcggtcttagtgcgctgtaatatccaacgatatagtccgttattgcgtgagctgcatcgctgaagcttacatagcccgtcgccggcacccattcgttcttcagactcctgaagaagcgctccattgggctgttatcccagcagtttccacgccgactcatactctgcctgatccggtatctccacagtaactgccggaactgcctgctcgtataatgactgccttgatcgctgtggaacatcaccccgacgggcttaccacgggtttcccatgccatttccagtgctttcatggtaagcctgctgtccggcgagaacgacatggcccagcccactggttttcttgcgaacaggtcgagaacaacggcgaggtacgcccagcgcttacccgtccagatataggtcacatcaccgcaccacacctgatttggctcggtcacggcgaactgccgttcaaggtagttagggatagcaacatgttcatgaccaccacgtttataccggtaagtcggctgctgacagctgaccagccccagctctttcatgagtctgccagcaagccagcgccccatctggtagcctctctgggttgccattgtggcgatgcttcttgctccggcagagccgtggctgatgccatgcagttcaagtacctggctgcgtaatacagcccgtctgccgtctggcttttcaggacggtttttccagtatttgtagctgctgcgatggaccccgaacacatggcagagagtggccacaggataacgcgccctgagtttcccgattatcgagaactgttcagggagtctgacatcaagagcgcggtagccttttttaatatttcattttccatttcaatacgttgtagctttttcctgagctcacggatttcaatttgttccggggtaataggggaggcttttggtgtttttccctgccgctcatcacgtaattgtttcacccatcgcgtcattgtggaaaggccgacatccatagcgctggctgcatctgccacggtgtaattctggtcaacgaccagttgagcggattcgcgtttaaactctgcgctgaaatttctttttttcattatggcacctgtgttgttctgaggtgagcatatcacctctgttcaggtggccaaattcagtaaaccacttcactgaagttcaaaacaccgaaagagataattgaaaggggtgttgcattgacagattgaatctacaaccgcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacagaaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctaaggctacgctgtaagcagaaacgcaagttcagagcgactacgaactcgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaaaaaaagaacaaatggttgtgtccgctattgccagtacacctcaaactgagttctcatggttccgatacggacagtataacgaaacgggtatttacatctcgatcgagaagaccattatcattacaatcaccgtttctggtgggtgctttaaaaaagaatacagcattgtctcccacatgctggtcactgacaccataacagaggccaccctgtacgaaaacgggctgtatacgcgccacatcagactcagtcgcccagtatctgacagcaaataccccttgccacccggatctcagctcattaaaaatatgaccttacgactgcgcctgcaggatcagcaggaagaaacatccgtgacattatttcagggaaaaatgagtaccgacggaaataactattccatcatcaaaggtaaagtaagctcagtacttctgttattaaaaatgctgcagattaatcatgcctgatctctgtcccggtattttagcccgaggtatattctgaaatatcattcatcatgaccggcgtttatacaaacgccagtcattcgctaacagcttcaccgttccttcccccatccaggttccgcatgagcgtgttgtaatgttcataagcgtattatcaggattgtctggaaaattcccgatactttggactattactcctgaacaactgtaagcgtacagcctgaaccgtctggtcagaatctgacgaattagacaaagtggtgtccaccaaataagtagtgggaaccaaagtgtcagatatgcagaaaaatgtgactcccggcaggcgaaaaggctgccctaattatcctcccgaatttaaacagcagctcgttgggggatgcggacgatttcctggactctcaggagataaaacatgtttactgaagaagaaaaaatccgcgccattgagctttatttcaaatatggtaagaagctggctcccgtcgtacgcgaactgggctacccttcgaaaagaaatctgcggcgttggatccgctcatgggaagcaggtggtggcgcaaaagaatccattcgtcataagcaccgttactccgatgagcaaaaacaggttgccgttgaacattatcttaaccacggctgctgcctggcgtttaccagcagagccctgggttatccctgcactgatgtactcgctcgctgggttaatgaactttatcccgacagacgacgtatatttaccagtaaggccaacccggttgcgccctttgaaccagaagtcaaacgtcaggctgtcatggcactctgtacacgacaagtatcagccagtgagatcgccaggcgtattggtgtcagtcgtgcggtattgtataaatagaaagatgaaattatcggcaacagtgcttaccagactatgcgtaaacataacgaaccttccctggaggcagaacgcgatgcgttgcgggaggaagtcgcccgactgaatcaggaaatacgccgccggcagatggagctggatattctgaaaaaggcggaggaaatcataaaaaaagacccgggcatcagtatcagtcacctgaacaacagagaaaaaacaaagatcgctgatgccctgaggcaaacatatcccctgacagaattacttcatgttctgggccttacccgtagcagttatttttatcaccgggctgcactgaaagccggtgataaatacgccacgatacgtacgatgctgacagatatatttaacagtaattaccagtgttatggctatcgtcgcctgcatgcgatgctcaggcatgagggggggcggctatcagaaaaggttgtacgcagacttatggtggaggaacagcttgtcgtcagccgtaaccgtcgtcgtcgctacagctcatattgcggagaaatcggaccggctccggataaccttatcgccagagattttaaggcgtagcaacctaatcagaaatggctgacagatatcacggagttccaactccctgcaggtaaagtctggctgtcaccggtggtggactgcttcgatggaaaagttattagctggtctctcagtacacgccccgatgctgagctggtcaacactatgctggatagcgctgtcgaaacgttaaatgctggcgaacgaccggtgatacacagtgacagaggtgggcattatcgctggccaggctggctggaaagagtgaatgcagcaggtcttattcgctcaatgtcccgtaaaggatgttcacctgataatgccgcatgcgaaggttttttcggcagactgaaaacggaaatgtattatgggcgtaaatggtcgggcatcacgccagaaaagttcatgcagcatgtagatgcttacatcagatggtataacgagcggcgtataaaattatcgctgggtgcagtcagccctgaaatgtaccgccaacaatgtgggctggcataataaagcagtctaggaaatcgtccgcatccccaattcaggggcggttttttctttacggtttttcgccataaagactattactatcagactgacaagactacccgcgaaagccgggagttccgcgccaagattaacagccaccagatactggggaattaatgtactgacaccacacatcagggtaattagtccaacgcctcgtatagtcttcataccaccaccgataatcgcgacgatgacgaaaggaagcagaatgttgaacagtgccagttgaagaataattgtcccgctgagtgtggttacaggtaaattaacttgttcagcaagtacagagacaggtatacctactgccccaaacgctgtagggactgtattagcaaccagtgatgcaatcgctgcttttagtgggttaaagcccagagcaatcagtataccaatggggattgctaccgctgtaccgtatccggctgccgcctcaagaaatccaccaaaacaccatgagataagaagtacctggatacgtttgtcatcactaacactcgctcaatcatttggtctgctatctcaacagattgctttcaacattattgtcagaatctggagcagattgaagatcgcatacttcaactcgatcaggaaatatctcgcctgttacctgagtgatctctgtgcaatctggtctgccagttgcaggctcttaaaggtgttggtcaactaatcgcaataaccctggttgctgaactgggtgatttttcgcgattttccaatcctgaacagctcatggcttttctgggactggtgccaggtgaatattccagcggaaacagcattcgccccagaggaataacaaaagttggaaacagcgaactgagacatctgctttacggatatcaaataaattcagattatttaacagtaaaaccccacttatgtgatgaatctcataaaaaagcaaagtgaagtaataatatccaatttatccctcattccttaagtaagcgtacactggccgcgtacaccatggcataatgatatgttgttttactgatatttccggctggtaaaatccccgacggcccggctgaagctggtgcaggaaagcgggttaattgtcactacgcgggataacctgtctggctggatacaacgtattgccacagatatgcagcaactgcgtcagtccggaatgtcagtcatctccggggatgttggggtctcaggcacactgaccggccccccgtgttgtttccgggtactgtttttgatttatgcaacaaagtattgcagcgtcgaatatgagctatggccagatttttgttaatcgtggttgttgcaacatgtaaggcgaatgaccacactattctggcacgctcgtaatcacgctgaaattccgcttcctgtgctgccgtgaagagttccgaccaggacatacggcgaagtgtatgtctgtcagtaatatccgtcatgagctctcagcttcctccttcgtatttccgtcagaaacacaaacgccccgcagagaaaattcgccaacattctcctttttaatggcgtgcaatgcatcgcgacaggcccgttcggtatgaaatgcctggctgtgcaccgccagtgtgggctgccgggcatcaccggaagagacattaaagggagatgaaagccagaaaatcagtagccacatgcgtcacacctcgtcctttttatgcgggtatctggccagaatattgagcgcctgtaatggagcttcatgcatttcacggatacaacgggcatcggtgatgttttccctgtaatgcgtggtttccagcatcatatgatgcatatgcagcatccgggccagggctgcacggagttcttcaatatgttgttcatgggaatgctgacggggtggtatccggcagagagggataacctccacatcatccgggtgcgcgcgaagccacgcgtcagtgactgtaatgtcgtcagtgtaaaaccatgtgccggatgtcccgttggccagaaaacgcattttccaggcttctggggtggcggttgtgctgttatctttcatggtgccaccactcattcaacaggcttaatgctgtccaggcgcagtctgctcagactgtcgtggctgccacagcggcgtcctgtacttttgctgtagcactcctgccccctgatacaccatgccgttggcgtttcgtagaggctgacacgtcgggttttatctttactggctagaagcccggtgtgagtttttgtctttttcatcggtggggtacaaacgcagaaattttgttgtcatcagtttttgcctgcagaggcctgaaaagacagcgttttcagaccctgttcaggttagtgaatattcttacctggcctttcggcaatatcaatcccctgaagttgcatggatatcccatgcccattgagcatctggctgtccatggaatggataccgcatgtcaccatcaggttgtaacaaagcgtactcagcatggcgagcgcctcttctgaggatttacaatgtgtgttcataagggccagaaactgctcaacaacatccgggttgatgctggtactgtgtatttcatccttcattatgtgtccttgttttttattattttgcatttcagaaaataacacgatgcatgtaacccagaaaaccgatatgtgcacgcgtagtcactttctggcagattccggtctctgaaacaaaatacgaggtggcatgaagcggattgtggcggacagggaaagtgatttgattccggggaaggcgctgtgcagcagtcttatccggcagtttaaaggggtggacggagaccaatgaggcactggagcagattcagtgcagaggtgacatgatttatcaaacttaattgtgacaaaatggcgattgagaaggtgcaattgacttatccggattcggtcgtggcgaggtggtgaccctgcattctgctaaccgggttatgagccaggagtcagcgatagacaaagggacttatctgaccgggcccccggaaaaatggcgggagagaatgataccttcctgctgacgagaccggactttgagatgacgagcgatagtgcggcagtgatgtacagcctgatcggtagctgcaaaacttaacggaatcgagccggaaacgtggctacgccacgtgatcagtgtaatcaacacctggcctgccaaccgcatgaaagagttgttgccctggaacgtcactctctctgtacactaatttttaccccacgtccttcacggtgcgcttacactctggacaagtatgtaaatgataagttaaaaataatccgtgcatttcctgtgacgatattagttgttggtaacgaaatctcattagcggatcggaaatgcacttaacctaatacgttgccactgttccgccaggagttacagtggcaacgtattctaccgtcagtgatagcgttttgttattatcagaactgatagttcagcgacatccagtaatttcgctcaggtatcacatatcctgttgttgatgatcccgtctggaagtaatcaccggcatacagcgtactcttaccggcactgtacaggctcacgtcactgtaatccttgttgagcaggttattcaccgcagcattcagcgtcagggcatccgtcatcttccacgacagacctgcattcaccaccgtccaggctttcaggtattctcctttctcatcatacactttcttctgtacagcgctcagtgacgaataattctgggtgaaacgtggtgttttcccgcgataacgggcacccagccatgatgccacctcttcggtgatctgccagttcagtttcgcattcaccatgtgttcaggggtataactcagcggcgcacctttgttatcaccatcacgttgttcacttcgggtccaggtgtaattcagtgacagcgtgacatcctctgaccacagcggcaatgtgccggcaaattccacaccatgcaaccgggcctttccgctgtttacatagctattggtgttatcatttacggaataagagacaatcttgttggagaagtcagtcataaaacctgtgacattggcattcagaccggcggggttatcgtaatacaccccagcctcataactgacgctctcttccggcttcaggtcggggttaccaagtagatttgtttttccctgcccggatacaccactaatccctttatgtagctgccccattctgggtgccttatatcccgtggtcacaccgcctttcagcgtccaggcatctgccacatcccagaccagatatgcacgcggactgaagtgtcccccgaattgctcatgatgttcatagcggctgcccacagtcagcgcaagtgcatccgtgagatgccactcatcctcagcaaataccgaccagcttttctgccggaaagtttcacctgtgctggcaaggacaactccgtctttcatggacgagctctgaaactcgccccccaccgtaaccagatgagattctcccagaggggtaagcagtaatgaattcaggataaggttcgattccttaagctcccgcggctgaccggcaagcccccatttgtcgcgcttcagtacactgcgtacgagctcacgacctttattttctgtctcgttccagttcagatacgatttccatgttccgaaggtgaaagtatgatcatagccagctgaaattttgtttcgctcatagcgcagggtccggtcatatccccccgtcagactccccagttgcccatcccggttatcataacgctgccgggtggtatccatatcaaaccagagcacatcctgcgccgacgccttccagtcaagacgtgcaccaagattataattctgtgactccgtgggataaggaatacgcgtggctgctgtatcgctcagtgatgtgaccgatgagccctgacgctgttgtgtgctaccgcgtacctgcaggctgacagaatcatccacaaggggaccactgctccagaaattaaactggctgctgttaccccatttgttgctttcctgcagattcagccctgcattgacggaagagagccatttgtctgcattctttctggtaatgatattcaccacaccgcccatcgcatcagagccatacagtgtggacatcggccccctgataacctcaatacgctcaatggcggccagagggggcatgaacccggtattcatggcagaaaaaccgttgggagtcacgtcactgcttccgccctgacgaacaccatcaatcagtatcagcgtgtaactggctggcattcctcggatgctgatttccagcccaccggttttacccgtaccactttcaacatccacaccctctactgatctcagagcctccgccagatcgtggtactggctggactgcaattcctcctggctaatcacagaaacactggcggctgcgttagtcagctttttctcatagccggatgcagagacaatcatcacatcctctgcagcagctatgctgctggctgaaaatccgagacagggaatgactacggaagccagagtggttattcgcatattactaatctccgatcatgttaaccggcaagacaatacataaatacaaacaataatgagaataatttatatttgccttttacaaaaaataaagattattgacaaaactaaatataaataacgactgcctcggcatgccagttaacagctatccgtatggcgtgttcggttttgcgaataaaaaatggttactgtagaagcggatttccaccacatgtcaaccatgaatggtcagtggtgcgagacgactgggatgatttggtcgatgacttcttccggcgaatactgatagaaacattgaaatattgtaagagaaagcgttcaaaattctgtggcacgtgaaaaattctacagcgtcatcaccttattcagtcgaccttcaaaataaacgtttaacagagacaatcaccatttggattgtccgctgaggaggcgaacgatttcctagacagctttatcatgtcagcccacattgttggcgctgacaatggatttgcccctatatttccagacacctgttatcacttaacccatcactggcccactgccgcagatattcccgtggcgagcgataacccagcgcactatgcggatgccattcgttataatgctcgaacgcctctgcaaggttctttgctgccgttaacccgtctggtttgggcatgatacttatgtagtcacgctttatcgttttcacgaagctctctgctattccgttactctccggactccgcactgccgtgttcttcggttcaagtcccaacatcctggcgaactgacgtgtttcattcgcccggtagcatgaaccattatccgtcagccactccactggagacgccggaagctcgctgccaaagcggcgttccactgctcccagcatgacgtcctgtactgtttcactgtcgaagccacccgttgtgaccgcccagtgcagtgcctcacggtcacagcagtccagcgcgaacgtgacccgcagtttttctccgttatcacagcggaactcaaacccgtcagagcaccatcgctgattactttctttcacagccactctgccggtatgtgcccgtttcgatggcggtacagcgggttttcgctcaagcaacagcgcattctggcgcatggtccggtaaacacgtttggcattgatcgcaggcataccatcaagttctgtttgtctgcgaagcagcgcccatacccgacgataaccatatgtgggtagctctccgataacatggtgtatacggcgaagcacatccgtatcatccgtgtgacggctgcggcggccgtccttccagtcatcggctcgtctgagaatgacgtgcaactgcgcacgcgacacccggagacaacggctgacgaagcttactccccatccccgggcaataagggcgcgtgcgctatccacttttttgctcgcccatattcaacggcttctttaaggagttcattttccatcgtttttttgccgagcagacgctggagttctttaatctgcttcatggcggcagcaagttcagaggcaggaacgacctgttctccggcagccacagcagtaagacttccctcctggtattgcttacgccagagaaatagctggctggctgccacaccatgttgccgggcaacaagggagaccgtcattcccggttcaaagctctgctgaacgatagcgatcttttcctgtgtagtacgccgtctgcgtttctccggccctaagacatcaatcatctgttctccaatgactagtctaaaaactagtattaagactatcacttatttaagtgatattggttgtctggagattcagggggccagtctaaccactccgtcatgtctctcagagaatcatgtcagagctgtagatatatcctgaacttgtctacaaataatttcttattttttgcgcataacattcagcaataactccccttctggccattgaattaaaatgtgtacttctctgtgacgttgtccagcttaattctgtcctccatgatgaccccagatacccgacagataaatcatcggcatcttcttctggctcattagttaattcatgtcggttactatcctgaaagctgagaaaatgtatttcatcatcagtccgttgtctgtaatgtccatatataaaatcatattctttttgataagattccttccagtaccaggttgtatcaccacacaaccatggaactctttctgacgaattaccaacacactgagatgagtattcagataactcagacctgaaagaagttaccatctgataaaacaagtcaggatgcttttcataatctggtgacataagatcaaactccccctgcatccagcagacagatagcagtttattctttctgttatattccagagctaccttaacccgggctactaagtcctcatagagtgctgttccggtgccccaccgcattgcatcagctgttgcccctgtatcaggtacatacataccttcagctccaacagtaaaggcggcacctcctctgcaacaaggaaccagtaatatccctgcttgctcaggtatgtatggcagtaactttttagctatatgcaatccctgtccgacacaaccatattcccctttatgcaaatcagcagccggatggtgatatccactcatatcctgaacatcatgcaggcagtgatctgccggaataatctcattgaatttacactcttttcctcctggtgtgattgtttttcgacgagccagttgttttacacgggactcgggtttgtcgagtgtatctggcaggggaataccttcaccgtaggccataccattagactgtcctgcgagggctatcacataccagaaacctattttttcattaaaatcatgatgatacatcattccccctttacataatagatttaattaaatattttcattattaaaagaaagtgttaaattaaaaactcatttgctctaatccatataaatcaatatatgtccgacaacaaaaaaaccgtgttacccgggctaacaacgaccagaaagcccattgttacaaaaaaactttcagaaatcgttgccgaagagcttgaaagaatgatccgccaggaggagataagggaaggtgaatacctgccttctgaacgtgaacttatggcattctttggcgttggaagaccatctgtcagagaggctttatcatctctcagacataaagggctaatccggtataacaagggagaaaaagccagtgtctgccgtccatcaccagaaaccatcattaatgggttatcaggcattgttaaagattttttatctacagctgatggcatcaaggattttgaaagactacgcatcttttttgaaaccaaccttgtaagatatgcagcaaaaaatgcaacgcctgaggatattcacaggcttgagaaggtgctcagtatccatcataactcactgagaacccccgaagtgtatgctcaatatgatattgaatttcatagtatacttgctgatatacctgacaataaagtattaaaaacaatacactcagcattttctgaatggctgataatggccaaacctctggaaaagaataaaatgacatatgaaaataacaaaaaaacccatcagcagcatattgaaatacttacggccataaaagagcatgattgtgataaagctgaacagctaatgtataatcacctttataaacgaattgaagcatcatagttactcgacgcttcaccaggtagtcaccataaatattatttaaatccatgagaatacatccagtccataaacagttttatccatcctccaacagaaagatctgtggcccactgaatactaaaaccatgccctcctttctcatagagatgcatttcagcagaaacgcctttctctattaggccacggtacatgagcagactgttttcaattgacacaagatcatcatcacaacaatggagtaaaaacacaggaggaaaacatgatgtgacattaagatccgcactatattgtattatattttctgaggtactattgtcccccagtaattgcttcctggagcctggatgtgtcacatcatctttcattgatattacaggataaattaacccgacaaaatcgggaatagcgaaaatctcttgttctttactgtcagaagaacgtttgaaatcacaaatctgattcacaaacgttgaggcgatatgccccccagcagaaaatcctaatacaccaatacgatgacgctgtagatgccatttatcagcattcttacgaatataaagcattgcagatattgcatcaataaaagttttgtttatattttctccctcaactggcgatggtaatctgtaactaagaacaaataatgtatagccctgagataaaaactctggagcaagagctgtaccttccttatctaacataacagcctggtagccccccccgggaataatcaatattcctgttccatttggtttatctggtaaaaaaataattaactgaggagcataaatatctgtcaatacacgatcaagttcaaattccccgttatgttcaggatcctgataaatacggcctgaaagagatttactctcagatattgtctcacttgacaagtcaacaatagttgatttattaaacaagcttaacatcatttcatttaaagatctatctttattcattataaaccccattaaaataactcaggtgactgaacaactaatacagtcacctgcattacagttatttaacaatctttatttgtttgtcattttttttcagataaataacatctgaaacagctttaccatcttttttctccccccccagaatgagcatccccccctgccagggcaggcttacaccataagcaagtccttccggcaaagaaccaacttttttccagtcattttttattagctgatatatctcttttgaataggctttatccagtcctttatgagaccagtattcaccattgctatacttttctgccgcccccgggaaatatgcaccaccggccagaaagatatttccatcaataacagaggcatatgctcctgacaccccctcgggtgaagctactggtggaagttcagaccatttaattcgatcatgcgaaagctcccccgtccaggatctaacagaacgaagccccggttttctctcccctcccagtatataaatttgctgttctgcaaaaatcaccgatgaaccagcagttcccggaaatggagtcgttcccaggttcttccactggttttttgacgggtcataagaaattatatgattatttaaaaaataatcatcagcaggtttactaaaataatccctgttgactttctctgtcagcgcggaattcccttttgataactcgacatctgaaaagtatccattaaaaatattctcatttacaccaccagtagataccgcatgaccattatggataaaagaaacatgaccggcaagagatacagggggacgggtcatcaatttttcccatttatctttagcaatatcataggaatagacatctttttgtaaggttatgactccacttttatcttttccaattcctccaaatacatagatcttaccatcaataatagtagctgttgcctgctctctgggaactgtcggccattgcgctatcttagtccattttttttcactctggtttgtatctatcatataccagttatttcccagacttcctagtcctatatatattttaccattctcgatccctcctacaccatatttaaatggttcaggaatttccggtaaagctccggctaccgacgttccaataaacaagcagaagggaagatatataaagtttttcactttcattgtaatcaccttttaaaaattaatcagaacaccgacacggtaactattttcatgtttattatctttccccttatacaccccttgtttatccaagtaatcatattctatatatggggtgaacaccggtgacattttatattgcagaacaaatgcattttcagttgctgtttttttatgattcccatatttgaaattattaaccttcgtatataccgtggtctgccatgcaaacaaccatgaatcattaattttgtatgtcacataaccatcaaactgatgctgatcattacgcgccctgttgccatctaaatccgtctgtcggaaagctttccagtcatagcgatagcgtaaggccagattaagatctggcgttgcctgatacgaaattttcagataagggttatactgacttcctgctgacatccattgtgtctgaatccctgggattagagcccatttgtcatctattttatatgttttatttatatctattttattataattgagtgcaaacaattcattttcattgttgtgaattgtattccaggtgtttgactcaaaacttgcccaccaaccattattccacccctgactaacctgaatcaacgtttcataagcgtgactggcgcttctgtatcccccacgtagattaagagttaatgcctgagagcacaaaggtaaaccaagaagaattacagttaatagtggataatattttttcataaatgcctcatcattaaatatatttatcacttgtaatttgatttctcaatgaaacttatgttccgcaagccattccagaagcaggctttgccatttttctatcggatatccattttttccggatacaccaaatccatgacctcccttatcaaaaaaatgagcttctgcatgatgtcccttatcccgaatagagttaaaatatctcagagaatgaataactggaacatccttatcatctgttgcatgcacaataaagactggtggcatatactctgtaacactattttcaagactggctgaatattcactttcacctgcatccagaagacgtttccggcatccctgatgagcaatactcctgtcaagagatataactggatatatcagagccatccagtcaggacgcacagaagtctcttcctcataatggagatgagtaatatatccagcaagatgaccacctgccgaaaaccccatacatccaacactcttaaatgttctctccgacattccggcccagtaagaaataaagttcagggcattcttcgcatctgcaaaggaataataaccattaacggagggcattctgtaagaaagaataaatgccgtatatccctgacctgctatccatctgccaacatcaagtccctctctttcataaacaatcctcctgtatccacctccaggtataatcagcacactatgttgattagatacaacaggctcaacaactgtaataaggggcacaatacctgtatatattatgccatcgccagtattctcaaatagcgaactgtcagttatgtaacgctcataattatcaagagaatatatattctccctgtaatgaatcatttttttattccctgatagcatccgttattcttctgcaacattcttttttcttgctccataaaaaggttttccatcgacagtatcatattcaagcgcagcttctggatggatccatctctgtacacgtgatggcatatcaaaaccaataaggacaagaacaacaaatgttaagataaaagcaagagaacacattgctgtaccaagacttgtatgagacgcaacaactgcaccaagaataggcgcacatgctccaccaagtgaacctacattataaataaaccccagtcctgccgcacgctgctccacattaaaataaccactgattattttcggcaccagagcaccaatcccctgaccaaaaacctgctgagtaaagattagaaggccaagtaaccatacatagtcccggtccacaagaaaaacggggataataacaagctgaccgataagaagtgatataacatatgcttttcgggttccaagccagtcccccataaaaccacctatacaacttccagctgcagagccaaaacctgccagcataaatatgagagcaacagtttctggtgaatactgcatatcaaccttaagccatgtaggaagaaaagcctgcagtggccatccgtagaggaaacagaacataaccacaagcatcaacataatgcctgttggccatcttttccccataccctgatatataaaactgataaaaacagccgcacagcacaatgccataactgtgattaaagcagcgtttgcagtgacgcctgaaaaacaaacatatagacatgcaaatgcaatacaagacagaagaatatttatgtatttattcttttctctgtacagaatatccaccattgttctgacgggtttattctcttgttgccttttttgccagtcatcagactccggaagattcttgcgaagataaaaagcaaataatattggaagcatgccgacaaagaaaagagaacgccagccccatagtggtactacaatgctataaacctgtgcagctaaacctcccccaatagaaaatccagaaattaaaaaaccacttgccttgtttctgagatgaacaggccagctttcgataacatatgttacacttgagccatattcacctgccataccaagcccaataacaatgcgagcaataaacatcactgcatatccaggagccagaccacaggcaagggttccgagagagaatagcactatacttaaaaccattgccatcctgcgccccatcttgtccgataaagcgccaatagcaagccccccaaaccatcgagaaataaaagcagcggaaataaggcttgccgcttctattgtcgtcaagccgaattcatgctgaacctctgtaagaaccagagatatcagaacgaaatcaaaaccatcaagtaaataacctgtccatgccgcaccgaatatcttccactgtctgggtgaaagatgcttataccaaacctgctttttctgaatacaggagtccatattaaacctcacaataatagcggatttataatacactggagtattactttaagtaatacaatcccggtcccaaagagttgcaccaataagaccagagtcacttctgaaatatgccggaaacagcattacattacaaatttcagaatatatggaaagatgtttcgacactttctgaacatacccatcagcaagtccaacacttcctccgacaacaacaacctgacaatcaagcagtaattttaaacttactattaattcagcaatagtactggcagaacgctctgtcaaaaattctgcttccttatatccctgtctcgctaattcaaaaatatatttggtgctatatcctgcaagtttattttttgctgcccccatgatggcccgaccagatgaaaccgcttcaacgcatccccgacgaccacatccacattctgtatccgttactccggacaatatatgcccaacatgtccggctaatccagaaacacctgttaataattttctgttaactacaattccccctccaacccccgtagaaacggttataaaaaccatatcacaaatttctttcggcaaaactgtatattctgcccatgcggctgcctgggcatcatttatcacacttccatttaaaccagttatatcttccattatatttttcagaggatactctttcagccctccaagattgtctggattcagagctgtcaatactccattattaataatccctgttgatgctactgcaaatcgctccgctgttcccttcatttcagaaaccagtagacgtaaagcccctgtcatttcgtcaggacatctttcatgaggtgttgatatctgttttttcagcaaaaatgaaccgtcatcagatatcaacgccgctgaaattttcgttcctcctatatcaacagccagtgttatcattcattttcacctatataacaatcttgcaattattcagattattttcatttttttgtttctgtcatgttcttcgaacagtcgctctgcaagttttgataatacatccagattcttttcctttaccggagaaaaaggacttctgcatacaggagtatttataatccccatatagtaaagaagagtttttatacctgccaggacaccactctgaataagagtgtcaataacctggttacaggctacttgcatttccttcgccttaatcacatcattgtttttgactgcttcaaatatttcaagataacgccaccccattatattatatgtactaccgattcccccatctgcacctgcaattaaccctgatgcaaatatttcatcgtaaccattatataacacaagctctggatgattccttttgatttgttccatctggaataaatcaccggatgtctgttttaatgcacaaaccctgggtattgtgacaagctcatttatctgatctaaagaaaaacgcactccgctaagagccggtatattataaactaccatcggaagtccatctgcagaatcaataatcttcctgtaatggatacaatgctcttcaaatgaaaaaggataataaaatggagtaacagcagatatagcatgatatccgtatttttttgcagcttttgcaagtacctcgctttctgccgtactgattccgcccacatgcgctataagtgtcagtcttccatctgattcatcggctactgtttcaagaattttttctcgctctgcaacattctgaagaaatgcttctccagtagagcctccaacatacaatcccttaatattttgttcgatattaaaacggatcagttttcgaagactctccatatcgatttgctgggattggtcataaggagtgggtaatgctgatatgacccctttaaattcacattgcatttttaatcaccttcacttaactgcataatgggatacctagtacaccatcaagtacaaagattatccaacagaaaagaagcacaatgtgaagattatcaaaaaaaaaccatcagaaagctgtcatgccgctcagttaaggatcggttgatcgatccagtgtccagttactattctctgcgtaaccctctgcgactatcttgccccggaactgattacccacagccctgaagagtccgacactgtcacgctacgcaaacggcgtcttcctctggaaatgatggcctggtgaattatcagtatggcccatgagcgtaaggaaccttcaccagattgtgaaccggctggacacatgctgccaggtagtcgcccctttgtcgcgccgtgatccatgcccagcagggccaggaagcggggccgtacgccacgtgttcacgtaaacagcgcagccctgacataacaccacgctgtatccgctctggtgcaatatgaacctgctgaccatcgatggcgtgttctaactaacacaggacacgccagaacacgacataaagcttcactcgccagatacatggtaagcgtaaactgaccgccgtatgtagccattaagccagtattggtaacgtaggtgcccaccttttcatcaactagtggacacctgttatggaacagaaaatattatccgcagaaccccgcagaacattttcaaatgagtttaaacttcaaatggttaaactggcttcacaactaggagcctctgttgcccgtattgccagggaacacgatatcaatgataacctcctgttcaaatggctcaggctctggcagaacgaagggcgtatatcgcggcgtcttccggtaacaacctcttctgacgctggcgttgaattattacctgttgagataacgcctgatgagcagaaagagcctatggcggctcttactccgcttttatccactccttcacaaagcacagtcagtgccagttcctgtaaagttgagttccgccacggtaacatgacgctggaaaatccttcaccagagctgctcacggtgttgatccgtgaactgaccgggagggggcgatgatctcgctcccatcagacactcgaatctcgctggttgccggcgttactgatatgcgtaaatccttcaacggtctgggtgaacaggtacaacatgtgctggatgagaaccccttctccggtcacctgttcatcttccgtggccgacggagtgacatgattaaaatcctctgggctgatgctgatggtctgtgcctgttcaccaaacgcctggaggaaggcctgtttatctggcctgcggtgcgtgacggtaaggtatccattacccgctcgcagctggcaatgctcctcgataagctggactggcgtcagccaaaaacatcccgtcttaacgcactgacaatgttgtaaaaatgtcatggccggattataaaaacggtcatgagtcggaaatacctcattcgtatcactgagctggaaaggctgctctctgagcaggctgaagccctccgtcagagagatctgcaactgagtctggttgaagagacggaggccttcctgcgctctgcactggcacgtgccgaagaaaagatcgaagaggaggagcgggaaatagaatatctgagggcccagatagaaaaactgcgccggatgctgttcggtacccgttctgaaaaactgcagcgtgaggttgaacaggctgaggcccaactgaaacaacgcgaacaggaaagcgatcgttacagtgggcgtgaggatgacccgcaggttccccgccagttgcgacagtcacgtcatcgtcgtccgttaccagcacatcttccccgtgaaatacaccgcctggagcctgaagaaagttgttgcccggagtgtggcagtgagctggattatctgggtgaagtcagtgctgagcagctggaactggtgagtagcgccctgaaagtgatccgcactgttcgggtaaaaaaagcctgtacaaaatgtgactgtatagttgaagcgccagcgccgtcccgcccgatagcgcgcggcatcgcgggctccggattacttgcccgcgtgttaacgggaaaatactgcgaacacctgccactgtatcgtcagagtgaaatctttgcccgacagggtgccgaactgagccgtgcattaatctccaactgggttgacgcgtgctgccagttaatgactccgctaaatgatgccctgtaccgttacgtgatgaacacccgcaaggttcacactgacgacacaccggtaaaagtgctgacaccgggcagaaaaaaggcaaaaacaggacacatctggacgtatgtccgggatgaccggaatgcgggctcatcagagccaccggcggtctggttcgcctactcaccagacaggcagggaaaacatccggtacaacaccttcgtcccttccggggtatcctgcaggcggatgcattcagcggttacgatcggctgttcagtgccaaacgtgaaggtggtgcacagacagaagttgcgtgctgggtccatgcccggcgaaaaatacacgatgtatgaacgacatctcttctgacgacattttcctgctgaaacagcgcctggccgaacaggaagcgctgatccacgccctgcaggaaaagctgagcaaccgggagcgcgaaatagaccatctgcaggcgcagctggataaactccgccggatgaacttcggcagtcgttccgaaaaagtctcccgccgtatcgcacaaatggaagccgatctgaaccggcttcagaaagagagcgatacgctgactggtagggtgtatgacccggcagtacagcgtccgttgcgtcagacccgcacccgtaagccgttccctgaatcactaccccgtgacgaaaagcgactgttgcctgcggcgccgtgctgcccgaactgcggcggttcactgagctatctgggcgaggatatcgccgaacagctggagttgatgcgtagcgccttccgggttatccggacggtacgggaaaaacatgcctgtactcagtgcgatgccatcgtgcaggcacctgcaccttcgcggcccatcgagcggggtatcgccggaccggggctgctggcccgcgtgctgacctcgaagtatgcagagcacaccccgctgtatcgccagtcagaaatatacggccggcaaggtgtggagctgagccgttcactgctgtcgggctgggtggatgcatgctgccggcagctgtctccgctggaagaggcgcttcatggctatgtgctgactgacggtaagctccatgctgatgacacgcctgtcccggtgctgttgccaggcaataagaaaacgaagaccgggcggttatggacctgcgttcgtgacgaccgtaacgccgggtcaacgctggcgccggcggtgtggttcgcttacagcccggacagaaaaggcatccatccgcagacccatcttgcggggttcagtggtgtactgcaggcggatgcatacgccgggttcaacgagctgtaccgggatggccggataacggaagccgcctgttgggctcacgcccgccgtaaaatccacgatgtgcacgttcgcaccccgtcagccctgacggaggaagcgctgaaacggatcggcgaactgtacgccatcgaggcagagataaggggaatgacggcggagcagcgccttgccgaacgtcagttgaaaacgaaaccgctgctgaaatccctggaaagctggctgcgtgaaaagatgaaaaccctgtcgcgacactcagaactggcgaaagcgttcgcatacgccctgaaccagtggccggcgctgacgtactatgcagatgatggctgggctgaggcggacaataacatcgctgaaaatgcgttgcggatggtcagtctgggccgcaaaaactacctgttcttcggttcggatcatggaggagagcggggagcgctgctgtacagcctgatcgggacgtgcaaactgaacggagtggagccagaaagctacctccgctatgtccttgacgtcatagccgactggccgataaaccgggtcggcgaactgctcccctggcgcgtagcactgccgactgaataacacatccccgtcaatacggtttttgctgcacgcttacccttctgttgctcactcagggcatgtaaatcatgctcaaaccacgccccctgagcatctgtctgcagaatcaaccggccatgacaggaaaggcagaaacaatgccggatatttctgctgagcgcagagtcggcactgataatgtgctcacccggcgtgatccccagccccgtttttataccgttcattctgctaccccctcctcactgaaacgcccggtctggcagtgtgtgcagtactgctccccataataatcgtggtgacattgcctgcagtaccagctggctttacgtaccacgggtaaggcatccgggacgaattgctgcagacgtttaatcaaccgtatttctctgcgttccggcctgacataaggacattgctgcgcgtgctccgtcagcccgtcgtcagtgtgttcaaaccagggccgttcggtgtcgtattgcgggtggtatctgagtgcactgccgcaaaggtggcaggtgtagtgggcataaggagcagtttgtgcggtacgggcaccggtcagacgtccgttgccatcaagtgcgagaaaagattttgcgtacatagtatatgttcctctgcgccagacgacacacaggcaacagccgtcccggtacgggcagcgtggtcaggtgtgaatggcggttttcagttcagtctcagaagggaaaatcagtgtggtcgctgtgaacacgtcatcacactaaggtcagataagtcgtctgtcgggctcagccacgactgcagccaaagttgcgctcaccggtgccgtaagctttggtactctccttcgccagatagtcagcacgctccagcacctgctgaaagccggtgtcatcatcgcgttccagccacaccgccggcctgaccggaaaatgtgccagcgtgtcataacgtccggcatccactcccagggcactgcaccacgcctgtttaatcatcccggccagtgatcccggagcgcggtaatcgccggcacgacaccaggtatcccggttgaccagcagcatcaggtgatagtgttttttacctttgcactccccaaactcccgggcccagacgtaatgcagggttgtgggatgcacgcgtttaccttcccgatgcttacgtttctggtaagcgtcgattcgggctttcagggcattgatgaagcgggatatcacagctgcgtccgttgctgccggtacatccgggaaacgcaggtcaacccgcaatgccgtcaggcgggaatgaacattcagtgcgtgccgcaccgtctcacgaatacgttgctgccagaaggggttgtatttgtaggtcatggttaaatctccgtatggttcatacggaataaccacgtcgtaaaaaatgcgcagagcccctgaggtgacctccggcaggacactgtctcaggcactctgtgataacccgaacggtcatcgccggactgacgattgaattcccggcgttgtttttttaatgtaaaaaacaggttacggataaggcgtggagagggagcgatcgtgatatgcaaaaagaagtgcagggactgtggtaacgcaattactcataatacagtatgttgcccgtattgtggcgctgtcgaccccttcggttattaccggaagaccgatcgtctgctctgtttactgacgttactgctggtgctgattctggttaccgtttcaggcgtcagtgtatttgtactgttgcagtaggttacagaggagggattatcaggaatcggcggggcagagcgacccgctgcgtttgttgtgccagacagtaacgcaccggctccctgcaaaatggtacctgaatcaatcacagtcaggtattccgccaatccgtgatcgaatcgagcggaatactcagccccgacaaatacgagtccccttcagaagatacaggccggtaatgcctgaacgcctgcccctctgtacaccattcccttttgatttcgaattctttgttgccgttatactgcttaatgttcccgatcttccggtgcacagataacaccggagtcatcgtagcgcggattcaagattcaggtgacatatttccagacggaagccggcacgcgatcgtaaagtttgttcattgtcagttctgccagccggtgatcgaccgcagagttaaaggcttccagctccgcaggggtaagtttataacgtgtgtgggaaatcactttttccagcgtctcccgggatgaacaacgacggaactgctctggttttaacttccattcgtctctcgttactttatgctgtaatcaacgtgatactgccagcataccgcaccagactgacattctggtaccctccccaaactcattactcccgtgcaaccacttaaccggtctctcagcaatatcgccttaacgctacgtttagttatccgacaccggatgtccgatgccattgcgacaacctgaaggtaaccagccagttagctgagatgttaagctgctggctgcatacaccttgccaaatctaatcgctgttatcttaaccaatttccaggatacaagggggcgattactgagaatgctctcagactgtcactcaccagatcggatacgtttaccgctcaggcggatgcttaatgcactctgttcaggtgcattgcaggtacgttttatgtacgcaggttatacgccagttatcagggataaccctgtgagtacaacgcaatctgttgctactgggtagactggtctgctgatcacactcacagatttatttcacatatatgaactcatgtgtttgagctctcttatatatttataataccaatcagacagtcttatcccaccagtgatacctgtcgcctgcccacaggtcacgggctgatgcaccacaaccgccttcaaaaacaactctgcaattatcagaacgccagttttccccttgtctcacgaaagtcctccctcctttatcacgtgcgcgtgcggaagcatcgtttcgcaacaatcacccgacataccggtacggctcagccaccgcaatccccccgtttatctcctgacggtcacattcccgattattttttacgtttttccccggttgttatgccggggaaggtggtgcgttgttttcatcaccaacgccggttgagattaacaacatccggaggaacattttcatgaataccccagtttcactgatggatgaccagatggtcgacatgtcgtttatcactcagctgaccggcctgaccgataaatggttttacaagctcatcaaggatggtgcctttcctgcccccatcaaactgggccgtagctcccgatggctgaaaagtgaagtggaagcctggttgcaggcacgtattacacagtcccgtccgtaattcctgaccgttatccgttcaaccgcagcaaaggcatgatccggcccccggaggcattttgctgcgcgctaaaggagagaatattatgcaaaaacttgaaaaccggtgtgagctgctgctcatccagcatcagaaatggatgacaaacgtgacgaggcttatcgtcgctcatggaatgggggctccgcatcttcatggttatcaccgcctgaccctggcccacttttttctgccagaaaaaggcaccatcatctcagtggcaccacagggactctatcaggtcgtcaacccgggaacaccaccgttcattcctgccattcaggaagggttaatgaccagcattcagacccatgaaatcatgctgcttacacattttaatctgggcggcgttttactcagtgagctacatcgtctgggtgaaaaccggctggcaaacaggctgaacagcctgctccggcgtttcgacgatcgtgatctctaccacacgctgatatggctgtgctggtatgatctgatgtgtgcccactccatgcagccctggactgaagagttaaagcataaatcacatgcagagcttgaaaactgggctgtggcgcgcaaacgggaaaagcgcgagctggaactgatgattgacgagtacctgttatacgcctgttgattcataacgctcccgggcctccgcacacttacttttcctccgtcaccctcatgcagaagcgggggtgacgggcatactgcgataccaccactgaataatccgtctcagcaacagggaacattataagccaaaggattgctcatgccatcttatcagtttctggctgtagcacgcattcagttcaggcagcgtgatattgtttatttcggaaagcaggacataggtggtttttccttcctgcacgacagagagcctgagttgagatgcaagaatgttcagcaggacgttcagctttttcctgttccggaaccggcccgggccacactggagaatataatttttcctgacacggggcgggcattctccgcggcactcctcaatgagccagtcgagcagctcccgggcgtcctgcagctgcagttcagattcatcaggtaacgcaaataattttttatattcatctgtgtaccacgaacttattacgacagcagacgtcatgatatcggcagagattttcccttcaccctgactgaaatactgcaataacgcagcaattctcgcaatgttttctgttttttttgaaacatgtccccgaaactggcttaagggtccggaaggagacaaatcctgctccagaacattatagtgatcaataaatattttttgcgcttcaggagaaaaatgcagacaataacgttcatccttactggatttttcaatactgcctctggccagctccattaatcgttcatgaaatgccgttaatgatcctcccggggtcacagctccgttaataaagcgtttcccctgcgtggtggcaggtttactgattagacaacgggcaagaaaaccactgtccctggcaacagaaccttttcgctccatatatcggtcaaaaagaccgggttgtaccatgagggataatgtcattctggcattttcaatcatctgttcgggttcattctttctgtccaccgacaatacggagccatcccacattttgttaataaaaggcagctcagacagggtatacccatcaaatattataccggcttcatctgacataatacccactgaacgccatttaccacaaagctgattcttaattgccgcagtcgtggcatcattaaaaatgaatttatatcttacaggtttttcccctctgtttttctgaagcgcttccagttgtctgagcgtttctgactcatccgcgcctttgcggagttctttattcagttttgacaacaatgcttttttctgcgcctttaaaagctcttccttatttttccatgtcgtcagttcatttttgtgtctggaatataacagcatctcctgctggtacaggggctccattaataatttgtccactgcggtttttcgttctccggactcagcaagcgtcagtaagaaaagagaaaccggcccccgtagtgtattcagtctgcagacatcaatcagattctggcagacaagtgaaacagcgcccagggcagatgctgccacaagccccaggggagcctgcgtgatttgctgagcttcaataacggcatcacgaatgagtggaggcagcgagctcaggggaaactcatcaggatactgaaagtatggcataatgacctcacaacacacagaacataaagtaccgcaactattgctactaatagcaaaaatagcagcagaatcaatacaggataaaaatttctgtcgattttcagattaaataataaccattcggtattttgtcgctaaagaatgtcagaatgaatctgtgcgtctacgggcgctctccggaacacacacgttgattaaatttcacacaacaacgtaccagcaaaaagcatcatccagggtattgcaggtacgggtttcctgccgggaataaacataaacagtttccccggagtaacgctttcagaaaactgccctcctgaagaagaataaaataaagaaaatgacagttcctgcactgaatgctgagtacaatattctatggacaggatgacatttttataaataacaaaaaccatttaatactgatacatcaataaaatacttcctccctgctgacacagataaaatgcaacattttttcttcaaatacttctgtataatcgccagccaatgatgagaatggattaaaataacacttcttcgacaaacacaaaaaccagccttcattttcacatcatcatccagttttaattaaaccctgacgagcgacagtatttcagttcaggaattaaaagccagctattactcagtaaaaacaccaccaactaataatatctcagcagatatttcctgaccaggatgacacatttattaaagtttttttacaggacacttcacattactgaacgctattccgacagtatcactacacaaataaaaaagggaactggataaatattcatgccggaagaatggtgtaacaaaagcatttaatcattacgtgcgtattcctatctattcgatcacggtttggccaaaccgtgatcgattcagatgccattttgcaagtacgcatgacccggaagggaaacacttaacaacatggtatcaacagatatcattacgtgcgcactcttataaaaatacacagcagaagcaagataactctaaacgtaaatttaatatctcccactgactgccccgacaatatactgaaaaatactcacctcagtaaacataaacacacctgataatcaggctgcaagatgaatatttttctcctttacggagtaatcagcctgctgtttaacaataaccgcgtattttcatggaaggatatcacccaataacggataactcctgccctccttcatgttaatacgcaacatccccatcgattccaaacaatttcagacagatattatctccgtggatcccccgccacctttccggtgtgcggggttttgtcttttttcaccgggaatacatgtatgaatccgtctgatgccattgaggcaattgaaaaaccgctctcctccctgccttactcgctttcccgtcacatcctggaacatctgcgcaaactcacccgtcacgagcccgtgattggcattatgggtaaaagcggggccggtaaatcttcactctgtaatgccctgtttcagggggaggtcacaccggtcagtgatgttcacgccggcacccgggaagtgcagcgcttccgtctgagtggtcacggttacagcatggttatcactgacctgcccggggtgggcgagagccgggacagggatgcagagtatgaagccctgtaccgtgacattctgcctgaactggacctggtgctgtggctgattaaagccgatgaccgggccctgtctgtggatgagtatttctggcgacacatcctgcagtgcggacatcagcaggtgctgtttgtggtgacacaggccgacaaaacggagccctgccatgaatgggatatggccggcattcagccctctcccgcacaggcacagaacattcgcgaaaaaacggaggcggtattccgtctgttccggcctgtacatccggttgtggccgtatcggcccgcaccggctgggaagtggatacgctggtcagtgcgctcatgacagcgcttcccgaccatgccgccagtcccctgatgacccgcctgcaggacgagctgcgcacggaatctgtccgcgctcaggcccgtgagcagtttaccggtgcggtggaccggatatttgacacagcggagagcgtctgtgttgcctctgttgcacgcacggttctgcgtgccgtccgtgacacagtggtctctgttgcccgcgcggtatggaactggatcttcttctgaacctgttgtggatgatgtcctccctgcctctaagtatgctcacaaaagcgctgttttcgttactgtctctcttgtccgtgcaatagcttgataaaagaataaaacgatcaatacccattttaccgatcgttaatatcgatcgttatgctaataataactcctgttagcaacgtgcgcagatacacacagacatgagattcagggaacaacagagccacacgtcagaaacttccgtcagccggacctccggcactgtaaccctttacctgccggtatccacatctgtggataccggcttttttattcaccctcactctgattaaggaaatgctgatgaaacgacatctgaatacctgctacaggctggtatggaatcacattacgggcgctttcgtggttgcctccgaactggcccgcgcacggggtaaacgtggcggtgtggcggtggcactgtctcttgccgcggtcacgtcactcccggtgctggctgctgacatcgttgtgcacccgtgtgaaacagtgaatggcggaacactggtaaaccatgacaaccagtttgtatccggaacagctgatggcgtgactgtcagtaccgggcttgagctggggccggacagtgacgaaaacaccggcgggcaatggataaaagcgggtggcacaggcagaaacaccactgtcaccgcaaatggtcgtcagattgtgcaggcaggaggaactgccagtgatacggttattcgtgatggcggagggcagagccttaacggactggcggtgaacaccacgctggataacagaggtgagcagtgggtacacgggggagggaaagctgccggtacaattattaaccaggatggttaccagaccataaaacatggcggactggcaaccggaaccatcgtcaacaccggtgcagaaggtggtccggagtctgaaaatgtgtccagcggtcagatggtcggagggacggctgaatccaccaccatcaataaaaatggccggcaggttatctggtcttcggggatggcacgggacaccctcatttacgccggtggtgaccagacggtacacggagaggcacataacacccgactggaggggggtaaccagtatgtacacaacggtggcacggcaacagagacgctgataaaccgtgatggctggcaggtgattaaggaaggaggaactgccgcgcataccaccatcaaccagaaaggaaagctgcaggtgaatgccggcggtaaagcgtctgatgtcacccagaacacgggcggtgcactggttaccagtacagctgcaaccgtcaccggcacaaaccgcctgggagcattctccgttgtggcgggtaaggctgataatgtcgtactggaaaatggcggacgtctggatgtgctgagcggacacacagccactaatacccgtgtggatgatggcggaacgctggatatccgcaacggtggtgccgccaccaccgtatccatggggaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccacacttaccctttccgggaagacggtgaacaacgataccctgaccatccgtgaaggcgatgcactcctgcagggaggcgctcttaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcacagtgctgaacggtgccattgaccccacgaatgtcaccctgacatccggtgccacctggaatatccccgataacgccacggttcagtcggtggtggatgacctcagccatgccggacagattcatttcacctccgcccgcacagggaagttcgttccgacaactctgcaggtgaaaaacctgaacgggcagaatggcaccatcagcctgcgtgtacgcccggatatggcgcagaacaatgctgacagactggtcattgacggtggcagggcaaccggaaaaaccatcctgaatctggtgaacgccggcaacagtggtacggggctggcgaccaccggtaagggtattcaggtggttgaggccattaacggtgccaccacggaggaaggggcttttgtccaggggaatatgttgcaggccggggcctttaactacaccctcaaccgggacagtgatgagagctggtatctgcgcagtgaaaatgcttatcgtgctgaagtccccctgtatgcctccatgctgacacaggcaatggactatgaccggattctggcaggctcccgcagccatcagaccggtgtaaacggtgaaaataacagcgtccgtctcagcattcagggcggccatctcggtcacgataacaacggcggtattgtccgtggtgccacgccggaaagcagcggcagctatggcttcgtccgtctggagggtgacctgctcagaacagaggttgccggtatgtcactgacgacaggagtgtatggtgctgcaggccattcttccgttgatgttaaggatgatgacggctcccgtgccggcacggtccgggatgatgccggcagcctgggcggatacctgaatctggtacacacgtcctccggcctgtgggctgacattgtggcacagggaacccgccacagcatgaaagcgtcatcggacaataacgacttccgcgcccggggccggggctggcagggctcactggaaaccggtctgccattcagtatcactgacaacctgatgctggagccacaactgcagtatacctggcagggactttccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtacaaaacacggtgtgagtgaactgcctgtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcaacagcgctgaaggctataacggtcaggccacgctgaatgtgaccttctgacagaaccatcgcctctttgtggtcccgatcatcatgatcgggacccggaccggcgcaacggatattcaacgccacattcgctggcattaacagtgcggcattcgacggacagaacggacagtatcgttacatgggaaatcatggtcccatgcaactggaagtcccccgtgatcagtatgccggcgctgtggaaaccatgaagaataagatccgcgaaggtaaagtacccggtgtaaccgatcccgcagaagcgtcccggctgattcgtcggggacatctgacttatacccaggcccgtaatatcacccggttcgggaccatcgaatcggtcacttatgatattgccgaggggtcggttgtcagtctggcgaccggagggatcagttttgccctgacggcatcggtcttctggctcagcaccggcgatcgcgatgctgccctgcagacagctgctgtccaggcaggaaaaaccttcacccgcacactggctgtctacgtcacaacccagcaacttcaccggctcagtgttgttcagggtatgctgaagcatattgatttttcgacggccagcccgactgtccggcaggcgcttcagaaggggaccggtgcaggaaatatcagtgccctgaacaaagtgatgaagggttcgctggtgacatctctggcactggtagctgtcacaaccggccctgacatgatcaaaatgttgcggggacggatctccggtgcgcagttcatcaggaatcttgccgtggcatcttcctgtgtggcaggtggtgctgtcgggtcagtggcgggcgggatattgttcagtccactgggaccatttggtgcactgacagggcgtgtggttggcggtgttctggggggaatgattgcctccgctgtatcaggaaaaattgccggagcgctggttgaagaagatcgcgtcaaaattctggcaatgattcaggagcagatgacatggcttgccggcagtttcctgctgaccggacatgagattgaaaatctgaacgcgaatctggcccgtgttatcgatcagaatgctctggagatcattttcgccgccggtatacaacaacgggccgcgaccaacatgttaatcaaaccactggtggtcagtatcatcaggcaacgccccgtcatggaatatgatgcatcccatctcggcaatatggttaaccgactggaagaaacattacccccggagttaccggcataacggctattctgcgccttttacgttttatcacctgatttgtcagtgtcatcgtcatgactcagagaggtaaataccatgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcctttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaacgttaactgatccctgaagtcagtttcatgcttcagcctctgtcacaacgcgtggcagaggctttttatttatcaggagaaaacagatatgctgggttacacagagtatgtcctggctgaaggatctttctcatacgggcaggcggttgctgtcataaccgcttaccgcaatgtgtttatccaggatgacccgggaatgcatttccgtcgggttatccgcaacgcggaaggtcagcgacgctggcgctgccggaactctgaagctgatgccggaaaacagcttaatgcgtggctcgccagtggagggcttctcagacaataaacctcattgatttcatccatcaggccgcgtcttctccgggagacgcggcttttttcatttattacaccagtaaatcttaaccaccgataaggagcaaattatgcgactagccagtcgttttggttatgcgaaccagatacgccgtgaccgtccgctgacacacgaagaactgatgcactatgtgccggggattttcggggaagataaacacacgtcccgaagccagaactatacgtacatccccaccatcaccgtactggaaagcctgcagcgggaaggctttcagccattcttcgcctgccagacccgtgtgcgcgacccgggccgccggggatacacaaaacacatgctgcgtctgcggcgggccggagagataaacggagaacatgtccctgaaattattctgctcaactctcatgacggtacctccagctaccagatgctgccgggttacttcaggttcgtctgccagaacgggtgcgtctgtggtcagtctctgggggaagtgcgtgttccgcaccggggaaatgtggtggacagagtcattgaaggggcttacgaggtagtgggcgtgtttgaccggattgaggaaaagcgtgatgccatgcagtcgctgattctgccgccaccggcacgccaggcgctggcacaggcggcactgacttaccgttatggtgacgaacatcagcccgtcaccaccgccgacattctgacgccacgacgccgggaggattacggtaaggacctgtggagtgcttatcagaccattcaggagaatatgctgaaaggcggaatttcaggtcgcagcgctaaaggaaaacgtatccatacccgtgccattcacagcattgacactgacattaagctcaaccgcgcattgtgggtgatggcggaaaccctgctggagagcctgcgctgattcagccattaccctgaaaaccacgcatttatttgtcctttaaggagtcatttcatgaaaaccatttcacataattccaccacatcttctgtttccgtaaccgctgcatcagggaatgaccagcctcagttggttgccaccatagtccctgatgaacagcgcatcagcttctggccgcagcattttggcctcattccacagtgggtggccctggagccccgtgttttcggctggatggaccgtctgtgcgaagactactgcggtggtatctggaatctgtacaccctgaacaacggcggggcatttatggcccccgaaccggatgacgatgatgacgaaacatgggtactgttcaatgccatgaacggcaaccgcgctgaaatgagcccggaagccgctggcattgctgcctgtctgatgacgtacagtcatcacgcctgtcgtacggagtgttatgccatgacggtccattattaccggctgcgggattacgccctgcagcatccggaatgcagcgccattatgcgcatcatcgactgaatggaggcagggacaatgcagcagctttcctttctgcccggagaaatgacgcccggcgagcgcagtctcattctgcgggctctgaaaaccctggaccgccatcttcatgaacccggtgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtaccacaatgccgctgccgtggtactggcgcacaatcacccgtccggtgaagtcacacccagtaaggcagaccggcttatcaccgaacgtctggtacaggcactgggcctggtggatatccgggtgccggaccatctgatagtcggtggcaaccaggttttctcctttgccgaacatggtctgctttaacccgtcacaaccacatcacacctgttttcacttttatcttctgtcttcagaggtatcccattatgaaaattatcactcgtggtgaagccatgcgtattcaccaacaacatccgacatcccgtcttttcccgttctgtaccggcaaataccgctggcacggcagcactgaagcgtataccggtcgtgaagtgcaggatattcccggtgtgttggccgtgtttgctgaacgtcgtaaggacagttttggcccgtatgtccggctgatgagcgtcaccctgaactgaatcaggacgggcattcagatgagcagcattatcaccatcacagtgtatacgctggatgaactttcctgcccggcacggggaaaagcccgcgactggtaccgtcagcatcatgctgacagcaactggtatgaaaacgtgtatgaagacttcagggaggtctgtggcattttcgggattgacctccgccagcgcgttttccggctcagcaatggcaggtttatggaagagccgtgcatctggttcagcggattctgcagccagggggacggagcctgttttgaagggcgctggcactggcagccagcgacaccccggaaaatcagggaatatgcccctcaggaccgtgagcttcatcgtatcgcggataccctgcaggcggtgcagaaacgtaacttctggcagcttcaggctgaaatcagtcaccggggacgttactgccatccgtacagcatggatatcaccgtcacccggaacagtccgactggtcaggcaatgacaaccgatgcggaagccgctgtcagcgaagccctgcgcgacctggccttctggctgtaccgccagctggaaaacaagtacgactggctgacctcagacaccgctgtggatgaggcccttctcatcaacgaatacaccttcaccgaagccggtctgcgcgccggctgacccgtcatcgttaaactatcattcaccgattttctgtgaggattttatcatgtcggacacactccccggaacaacgcttcccgacgacaacaaagacctcccctggtgggggctgccctgcaccgtgacgccctgtttcggcgcccgtctggtgcaggagggtaaccggttgcattaccttgccgaccgtgccggtatcagaggcctgttcagcgatgcagatgcgtaccacctggaccaggcctttccgttgctgatgaaacaactggagctcatgctcaccagtggtgaactcagcccccgctatcagcataccgtcacgctgtatgcgaaaggactgacctgcgaagccgataccctgggctcctgtgattacgtttatctggctgtttatccgacgcccgaaatgaaaaattaactctccagaatagccttctgctacggcctggtgttttcaccacgccacttttccatttttatatctgcatatcaggaaaatcttcagtatgaaaacattacccgacacacacgtacgggcggcatcgcgctgcccgtctcccgtcaccatctggcagacactgctcacccgactgctggaccagcactatggcctcacgctgaatgacacaccgttcgctgatgaacgtgtgattgagcagcatattgaggcagggatttcactgtgtgacgcggtgaactttctcgttgaaaaatacgcgcaggtacgtaccgaccagccgggattcagcgcaggagccccgtcgcagttaatcaacagcattgatattctccgggctcgcagggcgaccggcctgatgacccggaacaattacagaatggtaaataacattacccagggcaagcatccggaggcaaaacgatgaaactggccctgacgctggaagctgacagcgttaacgtacaggcactgaacatggggcgaattgtcgttgacgtcgatggtgttgagcttgccgaactgattaacgtggtctgcgataatggctactcccttcgtgttgttgatgaatctgaccggacctcaacagacagcatacccccctctgctgccctgagcggtatacgctgtagtaccgcgcatatcacggaaacagacaacgcctggctgtactcgctgtcgcatcagacgaatgacaccggcgaatcagaatggattcattttacaggtagcggatatctgttacgtaccgatgcgtggtcatacccggttctgcggcttaaacgcctggggctgtcaaaaacgttccgccgtctggttgtcacacttacccgacgttatggcgtcagtctcattcatctggatgccagcactgaatgcctgccggatttacccactttcgactggtaacccggaaattcacaacatgaaatcattaaccacggaaacagcgctgtatattctgattgcgtggctgcaggacaatattgactgcgaatcagggattatcttcgacaacgatgaggataaaacggattcagcagcactgctgccctgcattaaacaggccagggaagatatccgtaccctgcgccaactgcagcttctgcaacagaaccggtgagtcttactcaccagacttcattccactgacgccagcctgaatacggctggcgttttcgtttataaaccaaaaggaaaaacgatgatgtcagatatcacaatctcccgcccggaactggtcaacggacatacggacgttatctgctcaaccagtatccgccacattctggctgtacgaaagagtgcgctgctgcaaatcgacacacttatccggcaactggcagaaatctcagtactgacagaaagtattggaggtaaaaccgccctggactgggcgatgaaacaggattttcgctgcggctgctggctcatggagaaaccggaaaccgcaatgaaagccatcacccgcaatctcgatcgcgaaatctggcgtgacctgatgcaacattccgggatgctgtcattaatggatgcgcaggcccatgatacatggtaccgctcactggagtacgataactttccggaaatcagcgaggcgaatatcctgagtacgtttgaacaactgcaccagaataaggatgacgtgtttgagcgaggtgtgatcaacctcttcagagggctgagctggaattacaaaaccaattgcccctgtaaatttggcaataaaattatcgtcaacaatctggtgagatgggaccgatggggattgcatcttatcaccgggcaacaggcagatcgactcgctgacctggaaagaatgctgcatctgttcagcggcaaaccgatccccgacagccgggaaaatatcatcattcggctggatgatcacatccgctccgttcagggcaaagcgtgctatgaagatgagatgttcagcatcagatactttaagaagggctccgcacacatcacgttcaggaaaccagaactggttgacaggctaaatgacataattgccaggcactatccaaatgtattagcagacaggtaatgtggccttgccccgctattaaacatgtcatatttttgctatcattgtgaaaatttttcggaggaaacatgactacaaaagaccgtattcagtcccgactgaaccgttcaaaacgttatgtgttcacccgggatgatttcagggatatcgctggctatgatcaggttggcagagctcttcgtacactggtaaacgaaggtaagttgatgaaagtgggctatggtgtttacaccaaagcccgtcgtaacatcatcactgggaaaatcatgcccgcagcgcctgggggctctgctgcagtaattacagaggccctggagcgcctgaatatcagataccgtctggcaggagcaacggaatgctacaataaaggtcagtccacacaaattcctgtatctctggggataaaaacaccttctcgatttaaaagaatgttaatagtagggaaaagtaaaatcaatgcctgaattaacatcattatttcctgacgttgccgatgcactggatattgaatctgtcgctatcgtcgaaaaagattattttgtggttgatcttttaagattattaaaagaaataaaaccagaaacacatactctcgtgtttgcaggaggtaccgcattatcaaaagcaggtatctcgctaaacagaatgtcagaagatattgatataaagctcgtgccaacagagaactttatgcaaaatggcagagacaagagaagaaaaattcgcaaggaaatcgtgcaaataatcacggatgttattcataattctgacattttcagcttggataatgaaaacgcccgtataacacgtgatgagtatcgttataacgaaatctcggtacgttatccccagacatttgcacaagtcccctgtcttcgtccatttattaagctggagttgatggaaagcactctgctggaacatccggaaagcagagatatttattcccttgtcacggagttaacgggtaaaggtacacctgtaacagcattcccctgtgccaccattttatccactcaggctgaaaagctcatctccatgatgcgaagaacagcagcacatcttcgtaatcccgaacaacaggatgatgagtttctggtacgtcacatttacgacaactactgcattgtcagggaaaaaggtgtgaatgttcctgtattgaaaaattttgttcagatatgtattcagctatggtaaccagtacccacaattttgtagctcaccagttgatgaacttaagaaagggctggatgcactccgggattatcctgtacacaaattgcgctttcaacgatttgttaaaccgatggtatttggtaatacacagattaactgggaagaagcctattccagtttcagacaaacagcgctaagtgttctgaccagctaacaaacgcgttaagtacgattccacaattcagcatatcgaaccagaccaaatgattacagcaaagcacaaaaaagagggattatagcgtcaaaagaattcgaattgcacatgggggcctcattggtggcctcaaaaacaacaaatacaaaataatctatataaaacaatttgttatacaatcagtttcattccgattccgggcaccactaattcttaagaacccgcccacaaggcgggtttttgcttttggatctttatataaaataaacttgggtgcataacgccatcaggtcttaaacactcccgaatcatcaataaacatcccccgctaacaaaacacagttcagttcacataacatccctgttatcccacacatatctgctggccgaacgacgccagtgcgcgtacggaggcaagagcagccctgcacatggcagcgcttgtggtaacctggtttaatccggtgaaagaggcgttttacatgcatctgccagcagccggaaaaaccaaaaaagtggcgctggttgactgtatgcgtaaattgctgaccatcctgaacgcaatgctcagaaagaacgaagagtgaaatgaatcgtagcatcatgttgctccataatttttacgttcaagacagttgattatcggcgcatatgactcaaaaagagcctgatgattgcctcttttccataggctctttctctgaagtgaaggaaggcccggaagaaagcactcgctggcatacgtgactccagctcaaccggagataatcaccattgttatttttctatttaataataatctcctgaaaaatagatatagcaaaaatacaatccggccagatttaattccgcattcattaccagaaataatcaacactacaactattatatcattcaatagtcaccgctaaaattttattattttcctcttctttacatagaaattatcaacctgtttattatgccgaatttaaataattaatcacaaaacaacatcaccattatttgcgtgttttatttattaataacatagtcatacgttctttttttacaaggaaataatcaattgataaattgtttttggtattaatagtcaagtaggaaacattttaacaaatgataaaaatcctaaattccttgttcataatgtaggagtgtgttaaataggtgggcaaaatttggttccctttctcgcctgtaatattgcagcgtcttcgcacctccatgagacattgcgacttaataagaaggtgataagtcctgcatataagcatggactgaccatggttttatattcattaaaaattttgttacaacccattgatttagcataaataaattatagtgggttcgggtttgttgtgactgtggcattatttccgtgcaaaggagctgatatgtctgaaagacatttacctgatgaccagagcagtactatcgatccatatctaattacctctgttcgccagactctggcagaacaaagcgcagcattacaaaacttgtctaaacaactggattccgggcagtaccagcgtgtccttaatttgataatgaactgtaaagggcacgttattctttcgggaatgggtaaatcagggcatgtcggtcgtaaaatgtcagcgacgctggcctctacgggtacgcctagtttctttattcatcctgcagaagctttccatggcgatctgggcatgattacgccttacgatcttctgatccttatttctgccagcggtgaaacggatgaaatcctcaagctagttccttcactgaaaaatttcggcaaccgaattatcgccattaccaataatggaaattccacgctggcgaaaaatgctgatgccgtgctggaactccacatggcgaatgaaacctgcccgaataatcttgcaccaacaacgtctaccacgctgacgatggcgatcggcgatgcgctggcgattgccatgatccaccaacgcaaatttatgccgaatgattttgcgcgctatcacccgggcggttcattaggtcgtcgcctgctgacccgcgttgctgatgtcatgcagcatgatgttcctgcggtacagctggatgcgtcatttaaaaccgtgattcaacgtatcaccagcggatgccagggaatggtgatggtagaagacgcagaaggtgggctagcgggcattatcaccgacggtgacctgcgtcgctttatggaaaaagaggattctctgacatccgccacggctgcgcagatgatgacacgtgaaccgctgacgctaccggaagacaccatgatcattgaagcggaagaaaaaatgcaaaagcaccgcgtctcaacgttattggtgaccaacaaggcaaataaagtcactggccttgtgcgcattttcgactaattaagcaacggggtgcgagaggttagtctctcattgagtttgcgccccactgaaactttgataatcgttacatgttgataaaagtgaagtctgccgtatcctggatgcgtgctcgtctgtctgccatctcactggcagatatccaaaaacacctggcgaaaatcatcattctggcaccgatggcggtgctgctgatctatctggctatcttcagccagcctcgctatatgagcgagtcgaaagtcgccattaaacgctcggatgatttaaacagcggcagcctgaattttggtctgcttctgggtgcctctaaccccagttccgcagaagatgcgttgtatctgaaagagtacatcaactcgccggatatgctggcggcgctggataagcaactaaattttcgtgaagcgtttagccacagcgggctcgattttcttaatcatcttagcaaggatgaaaccgcagaaggcttcctgaagtactacaaggaccgtatcaacgtctcgtatgacgataaaaccggattactgaatattcagacgcagggctttagcccggagtttgcgcttaagtttaaccaaaccgtgctgaaagagtcagagcgctttatcaatgagatgtcacatcgcatcgcgcgtgaccagcttgcctttgcagaaacggagatggaaaaggcacgccagcgtctggacgccagcaaagcggaattgctctcttatcaggacaacaacaacgttctggatccacaggcacaggcacaggcggcgagcacgttagtgaatacgctgatgggccagaagatccagatggaagcggacctgcggaacttgctgacgtatctgcgtgaggacgccccgcaagttgtgagtgcgcgtaatgcgattcagtcattgcaggcacaaattgacgaagaaaaaagcaaaatcactgcgccacagggtgacaagctaaaccgtatggcagtggattttgaagaaatcaaatcaaaagtagagttcaacaccgagctgtacaaactgaccctgacctccattgaaaagacccgtgtagaagcggctcgtaagctcaaggtgctgtcagtgatcagttcgccacagttgccgcaggaatcgtcttttccaaatatcccttatttgatcgcctgctggttactggtgtgctgcctgctgttcggcaccctgaaactgttgctggctgttattgaagatcaccgagactaacgctgtcgctgaatgagtttgtgatgaaattatttaaatcaattttactgattgccgcctgtcacgcggcgcaggccagcgcgaccattgatattaacgctgacccaaacctgacaggagccgcgccgcttaccggtattctgaacggacagaagtcggatacgcaaaacatgagcggcttcgacaataccccgccgcccgcaccgccggtggtaatgagccgtatgtttggtgctcaacttttcaacggcaccagcgcggatagcggtgcgacggtaggattcaaccctgactatattctgaatccgggtgatagcattcaggttcgcttgtggggtgcgttcacctttgatggtgcgttacaggttgatcccaaaggtaatattttcctgccgaacgttggtccggtgaaagttgctggcgtcagtaatagtcagctaaatgccttggtcacatccaaagtgaaggaagtataccagtccaacgtcaacgtctacgcctccttattacaggcgcagccagtaaaagtgtacgtgaccggatttgtgcgtaatcctggtctgtatggcggtgtgacgtctgattcgttactcaattatctgatcaaggctggcggcgttgatccagagcgcggaagttacgttgatattgtggtcaagcgcggtaaccgcgtgcgctccaacgtcaacctgtacgacttcctgctgaacggcaaactgggactttcgcagttcgccgatggtgacaccatcatcgtcgggccacgtcagcatactttcagcgttcagggcgatgtctttaacagctacgactttgagttccgcgaaagcagcattcccgtaacggaagcgttgagctgggcgcgccctaagcctggcgcgactcacattacgattatgcgtaaacaggggctgcaaaaacgcagcgaatactatccgatcagttctgcgccaggccgtatgttgcaaaatggcgataccttaatcgtgagcactgaccgctatgccggcaccattcaggtgcgggttgaaggcgcacactccggtgaacatgccatggtattgccttatggttccactatgcgtgcggttctggaaaaagtccgcccgaacagcatgtcgcagatgaacgcagttcagctttatcgcccatcagtggctcagcgtcagaaagagatgctgaatctctcgctgcaaaagctggaggaagcctcactttctgcccagtcatccaccaaagaagaagccagcctgcgaatgcaggaagcacaactgatcagccgctttgtggcgaaagcacgcaccgtggttccgaaaggtgaagtgatcctcaacgaatccaatattgattctgttctgcttgaagatggcgacgtcatcaatattccggagaaaacatcgctggttatggttcatggcgaggtgctgttcccgaacgcggtgagctggcagaaagggatgaccaccgaggattacatcgagaaatgcggtggcctgacgcaaaaatcgggtaacgccagaattatcgtcattcgtcagaacggtgcggcagtcaacgctgaagatgtagattcactcaagcctggcgatgagattatggttctgccgaaatatgaatcgaaaaacattgaagttacccgtggtatttccaccatcctctatcagctggcggtgggtgcaaaagtgattctgtctttgtaaggggttgaaatgagcaaagcagttattgtcattccggctcgctatggctcctcgcgcctgccgggtaagccactgctcgatattgttggtaaaccgatgatccagcatgtttacgagcgtgcgttacaggtggcgggcgttgcggaagtttgggtggcaacagacgatccgcgtgttgaacaggccgtacaggcgtttggcgggaaagccatcatgacgcgcaacgatcatgaatccggcaccgatcggctggtcgaggtgatgcataaagtcgaggcagatatctacattaacctgcagggcgacgaaccaatgattcgcccgcgggatgtagaaacgctgctacaaggaatgcgtgacgatcccgcgttgccggtggcaacgctatgccacgcgatttctgccgcagaagcggctgagccaagcacggtaaaagtggttgtgaatacccgccaggatgcgctttatttcagccgctcaccgattccgtatccgcgtaatgctgaaaaagcgcgctacctgaaacacgtcggtatttacgcttatcgtcgcgatgtgctgcaaaactacagccagttaccggagtccatgccggagcaggcggaatcactggagcagctaaggttgatgaacgcggggatcaacatccgcacatttgaggttgccgcaaccggtccgggcgtcgacaccccagcatgcctggaaaaagtgcgcgccctgatggcacaggaactggctgaaaacgcatgattggcatttactcgcctggcatctggcgtattccgcatctggagaaatttctggcgcaaccgtgccagaaactttctctgctgcgccctgttccacaagaagttgatgctatcgccgtgtggggacatcgtcccagcgcggcgaaaccagtcgccatcgccaaagcagcgggaaaacccgtcattcgtctggaagatggatttgtgcgttcgctggatcttggcgtcaatggcgagccgccgctttctctggtggtggatgattgttgcatttactacgatgccagcaagccttcagcactggagaaactggtacaagataaagccggaaatacagctctgataagccaggccagagaagcgatgcacaccatcgtgaccggggatttgtcgaaatataacctggcacctgcgtttgtggctgatgagtcagaacgttcagacatcgttctggttgtcgatcagacatttaatgatatgtcagtgacgtatggcaatgctggcccgcatgagtttgctgccatgctggaagccgcgatggcggaaaatcctcaagccgaaatttgggtgaaggtgcatccggatgtcctggaaggaaagaaaacaggttatttcgccgctctgcgcgccacgcaacgagtacgtttaattgccgagaatgtcagcccgcagtcgctgttgcgacacgtttcccgggtttacgtcgtgacctcccagtacggctttgaagccttgctggcaggaaaaccggtgacatgcttcggccagccctggtatgcaggctggggcttaaccgacgatcgccatccgcagtccgctttgttatctgcccgacgcggttctgccacgctggaggaactttttgccgctgcatacctgcgttactgtcgctatatcgatccgcaaacgggagaagtaagcaatctatttaccgtgctgcaatggctgcaattacaacgtcgacatctgcaacagcgtaatggttatttatgggcgccaggcttaacgctgtggaagtcagcgatcctgaaacctttcttgcaaacggcaacaaaccggctgagtttttcacgtcgctgtactgcggcgagcgcctgcgtggtatggggtgtaaagggagaacagcaatggcgagccgaagcgcagcgaaaatcactgccgttatggcgaatggaagatggttttctacgttcatccggacttggctctgaccttttgccgccgctatcgttggtcctggataaacgcgggatctactatgacgccacgcgccccagcgacctggaagtgctgcttaatcacagccagttaacactggcgcagcagatgcgagctgaaaaattacgccagcgactggttgaaagcaaactgagcaaatacaacctgggggccgatttctctctgcctgccgaggccaaagataaaaaaatcatcctggtgccgggtcaggtagaagacgatgcctcaattaaaacaggcactgtgtcgattaagagcaaccttgagttattacgcacagtacgcgagcgcactccgcacgcttacattatttataaaccgcacccggatgtactggtggggaatcgcaagggcaatattccgacagaactaattgctgaactcgctgattatcaggcactggacgcagatattattcaatgcattcagcgcgcagatgaagtgcacaccatgacatcattgtccgggtttgaagcgttattacatggcaagcaagttcattgttacggcctgcccttctatgccggttggggtttaaccgttgatgaacatcactgcccgcgtcgcgagcaaaaattaacgatagcagatttgatctatcaggcgttgattgtttatccaacctatatccacccaacactgctacaacctattacggttgaagaggcggcggaatatttgatccagacgccgcgcaagccgatgtttattacccgaaaaaaagcgggacgagtaatacgctattaccgcaaattaattatgttctgcaaggtcagatttggctaaacaatttcacagttgactattacacaaattatttatgcaaggtaatgcactaaccgttttattatccggtaaaaaatatctgctattgcaggggccaatgggaccctttttcagtgatgttgccgagtggctagagtcattaggtcgtaacgctgtgaatgttgtattcaacggtggggatcgtttttactgccgccatcgacaatacctagcttactaccagacaccgaaagagtttcccggatggttacgggatctccaccggcaatatgactttgacacaatcctctgctttggcgactgccgcccattgcataaagaagcaaaacgctgggcaaagtcgaaagggatccgcttcctggcatttgaagaaggatatttacgcccgcaatttattaccgttgaagaaggcggagtgaacgcatattcatcgctaccgcgcgatccggatttttatcgtaagttaccagatatgcctacgccgcacgttgagaacttaaaaccttcaacgatgaaacgtataggccatgctatgtggtattacctgatgggctggcattaccgtcatgagtttcctcgctaccgccaccacaaatcattttccccctggtatgaagcacgttgctgggttcgtgcatactggcgcaagcaactttacaaggtaacacagcgtaaggtattaccgaggttaatgaacgaactggaccagcgttattatcttgctgttttgcaggtgtataacgatagccagattcgtaaccacagcagttataacgatgtgcgtgactatattaatgaagtcatgtactcattttcgcgtaaagcgccgaaagaaagttatttggtgatcaaacatcatccgatggatcgtggtcacagactctatcgaccattaattaaacggttgagtaaggaatatggcttaggtgagcgaatcctttatgtgcacgatctcccgatgccggaattattacgccatgcaaaagcggtggtgacgattaacagtacggcggggatctctgcgctgattcataacaaaccactcaaagtgatgggcaatgccctgtacgacatcaagggcttgacgtatcaagggcatttgcaccagttctggcaggctgattttaaaccagatatgaaactgtttaagaagtttcgtgggtatttattggtgaagacgcaggttaatgcggtttattattaacatcttatcaacaatcgacatctccattatatcaatcataacagatggatgatacctttattagatgtaaaaagataaagtattttagatattactaatatatattagatatctttggatatagcacataatatacatttccaacgcacaagccaagtattctaattaacattagagttatgaaaaattcgatataaacacaacagcagggcaagaaatttaaccaacatcttattttacgatcgaggattaataaagaacataccaacgaggcatatttttaacggattaaataatgcatttccttctcttaatagttaatagtatataacaatacattagtcacatttaaacaaatcgcgactatagactttgtcgaccacatcgttcaactcctctgacattcggttagtgataataatatcagctttccctttaaagatcgccagctcccgttccaaaggtgagttaaagaatgtatctccagaaataagcggctcataaataattactttcacgccttttttcttgatacgctttataataccaagaatagaagaatctctaaaattatctgaaccacttttcataatcaaacgataaacccccacaacttgtggtctatgtttcaaaataacattagtgataaagtccttacgtgtacggttagcatcaacaattgcagatataagtttattcggaacagactgatagttggctaataattgcttggtatcttttggcaaacagtagccaccataaccaaaagaaggattattgtagtaattaccaatgcgcggatccaaacaaacaccgtcaataatctgacgcgtattcagaccaaaactttctgcgtaactatccaattcattaaaaaatgcaactcgcatagccaaataagtatttgaaaataacttaatcgcttccgcttccgtagaatctgtaaataaaacgggtatattttgtttaatcgctccttcctgaaataacactgccaaacgttctgcccgttcagaacattcaccgataataatgcgagatggatggagattatcgtatagggctcttccttctcgtaaaaattctggagagaagataatattattaatacctaaatgttctttaattgtttttgtgaaacctactgggaccgtagatttaaccaccataattgcgtttgggttgatttccgttacgtcacgaatgacagcttcaacgcttgatgtatcaaagtaatttgaacctgggtcataattcgttggtgtagcaataataacgtaattggcatttttataggcttcatatttgttagtagttgcgcgaaaattaagtattttagttgaaagataattttcaatttccttatcctctataggagagagtttatcattaagtaagtcaacttttttttgatgggtatcaaatgcaaccacttcatgattttgagccattagaattccatttgaaagcccaacgtaaccagcgcctgaaacagttatttttagtgttccgaacattttatatagccccaaaaatttaatatatatagaataacaaactattgttcaattattcctgatacatctttaaacaaaccatagcgagataataaaccacgtacatctttatcacttacgatacttttccctaacactcgttgtcttgccgcgatatcactatattctcttcgagattgtgatatatatccatcaggtagagcttctgttcctttattcctggtaagtccggagtctccccataaccccaatatcaatggctgcagtaatcttacaatactttctcgcccataacgcattattactgtttcataaaactccgtatctgcaccaattaaagattgtctatagccaccaactgtcgcaaaaatatctttttttatcattgacgatacaacagacattcttgtggctttatcatcatagaagaattgaatttttccatttgacgcaacacggatccagttagccatacagattacagccttattattgcgaagaacctcaacttgtctttgtattctctccggatgagaaagatcatctgcatcttgaaaggtgatgaaattaccgtgtgctttttttattagctcatttcttatattataagggccttggttttttcgtgagctatatactttcactcttgaatcagaataagctatgctcttaattatttcaaggcttttgtccgatgaacaatcatcgcacacgagaatttcaatattttcatatgtttgattcaacaatgaatgtaatgagtatgcaatagtatcttctgaattgaatactgacattattatactaacaagatcttttccataaacattttttttcttatcgaacttaattccttgcaatataattttatttgggtatatatcagttatttctgataaatcgtattttcgtagacatttgttaaattgactcctataaatattcatattatctattacagcattacaaataaaaagttcttgctcagggagtagattataactatcttgcatatcatcgtttgcatttaataataaagtcaggccataccctgcatcggcttgattatcaaatgctaaatatttatatccatttttagtataatcatgaaattttgaaaacttcgtacaaaaataaaaatctttttgtttgggcgacaattttagatggtttatatattcgatatatcgttcaaaaataagattaatgagaaaatcactccttgaataccgtagagcgttacttatatgttcaaaaagcttaactcgttcgccatttttaaaataacgagattgaattgttagataacaaacaattttaatataagtatccaacataccaacttttctaagagaatctgcatatcccaataaataagaaaactcattgccagaattctgagctgatacattcttagatagttcaagtacattgtcgtattcgtttattcttttgtgaataaggttatcgttaccttttaaaggcgagtttttatgttgaagatcaactttctccttatgaattgataataaaaaatcaagagcaccaatatttgtccctaatttctttttacgttcaactaaatttatatattctgcgttcatacattcacttaatgataaataaaatgagaataaaactgcatttactaaatattataaatataaatctttaaaaacatcactaaaactcaacgaatgtcacagtgtaagctcacagagatattgcaattatctccggacaagcgagggaaatgctaagttgatgcaacgtatctgcggcggatatttgaggcattaccatgccaacatctatgtgatgaaacactttgttatacctgagattacaaaattaaggatgaaaaaatatacttctgggagaaacatgagatcaatacagttgcggaagtttttgctgtatccacacgaacgctgtattatggcccagaggcacctatttcgcgtagcaaagctccgctagtacatcgcacaaagcaatggcatctcgtaattctgtaagaaatacgtcgactgagaatagagcttcccaacctagaagaacagatttttgtttgcttgaagccgtggagtgaacagcaccgcctggtctgtccgagcatttcaaccatcggcaggatgttcacggccgcacacgataaaatgcgactgataccgatgtgactgcctccccaaggaaaaacactgttcataaaaaatacaatcctccaacccgcagatcaaaacgctatcgcccggtaaagagcagtgagctcgttggtatagatgctattgagctcagaatgggcgagctgcgctgttatgtcattaccatgatcgacgaacacagcaactacgctctggcacaggccgtgccgtcacttaactgtgatatcatcaaactcttcttttgccgtgcagaccggctattccctatcgatatcaaccagggcatcgcagataacgggaaagagttcccaggaaacttcgacaaagcaccgcaggaatccgctagcaagccctatggacctacccctttacgcctagaacgcacctctgaacgttttaagcgaacgccgaaagaacagttcattgaatttaaataaatagactctttaaagagctaaacatatttaatcagaaactagctgaaaacctagtactatactgcagtaaaagacagcatgaagtgctcgaattactgacaccagaagaaaatattttacgagagaacaaaatttgcaatatgtggcgaatctatacggtcacttgcaaaagtataaattggtattataatgcgtgatattatataaataaaataactaactattttaacgaaagcaaaacaccacaaagagaaaaataaaatttgcaatatatctcattagggttcacatttttaacagcccttgattttagctctcctatatttataaacaacaacaattaacttaaatggaagggtaatgaatccaaatatcgaattagcactggagataatagcctgccctaattgataagataaatgtttcttaactctttcagccttatcagcatcagcatataaatagagtggcacatcaacgccataactcttcttacgttttttttcaaaaacacactcacggataagtgcaaatggcatggtaataatccccttgagggatttagaatacgagactataatataaccaagtcgataacctaactcttgttttatctgctcagctgctccatatagcacaggtggaagtttctttttaatttcctgattttctataaaatagtgttccaactgctcttgcactatatgcaattgttttaaaatctgttctttttctgatattgcctgagtgagttttgattctttttcgcttatctcttcttcatatttatgcaattgttttaaaatctgttctttttctgatattgcctgagtgagttttgattctttttcgcttatctcttcttcatatttctgtatgtcatttatttttttttcaatatcatctggatatttttcttgtctcacaacatcgttgtgatttatttttgaaagtttaattacctcttccttttctttttttagctcattaatcctgttcaataataaaaattgtcttttcttaaatatagatttagtcaattcaatatctgcatccttcttttttgactcttgcaccaaatgagatacaatattgaagatagaatttctctcttcgactacctcccataatgcagcctcagccgaaacgttatctttcgatgtttctatataaggtaggtttgcataggcttgtaactcattataaagcttcagaacctcggttctttcttttattaattcagatactaagtactcactaacctttgtatcattaaatgtaatttcagtctcatttgcacttaaagaaaataaagttgtatatttttcaagcagggcaatttcatttgattttgtataatcattattctcaaccacatcaaacaatattgaatttttgtaatgcgcagacattagattatctatttttataatattactcaatggctttataatatttttcttattgctttgaaacgcctcaaaattaatcaacacacatcgttctttattctccaaaaaaaaatcaagcaatcttttattatatgcaatccagttatctacactattatttatatttaaagagagaggggcattatttactgaacgcattaaattatatttagggtgatcatatatcatgatgaattttatgcttttatctatatttttccaaaaatcaagaaaaaatattatagatggatctgcccacccccaaagtttgttatttagattgttcatcattagttcaagaaccatgctatcccacatggttgagacttgaacagctgagaattctctctcatctactacatcattaacttctggtgtttgataaaattgacataatgaagcggtgatatattctggggaaattttattacttgtagaataatttggtgagttcatgccaatttctttcaaaaaatgttcaactatctgatactttgagccaggatgtccgactagcactaatttattcatcatatttcctctttattatctacaagattactttattttaaacactgtcgtttatcgtaatggtgatattgcagacatatatttcaaatctgtaatgtaatttaggtggcgttatgtgataatactaaatgaaactatctatatctcaatagcacatctgatttatttggtatagccattcatcaataaacaatatcaatataactcagagcacctcctaataattgacatattgcgttaccaccttcttttagacaaaaatcttaattataaactctaccaaactaacgctgatatttttcaaaatcataaaacaaatggtttaaataagtatataacaaaatatcaacgtacaactatttaaaacaagtatttatactataaacttcagaaaccaacacaaaatacaggaatgtgaataaaaaagtaagtttttacccttccacattatacactaattcgaggttaagttttgaatatcctgcgattgcttgtgtttcttttatgatgtctaaaggccatttttttgtaaatgtgttccaaagtccttccattgaacctgatgagacctctcttagccagtttttttctctgggaacacatatcataccaatttcattctctaacatatagcgagaaaatctaacatcgacgaatcgttgagaaccatccatatattttaaagatggtaattgatctgccttaagaaaaacagtccctgtacctaattgatttacaactctcggtcgcaatagcccttgagtaaatgaaaatacttttcttttagactgatctccatcaaatgcatctatgtatatacagccatgaatcccaacaatgcaattgaatattgcaaaggaattataaaaattgagcattttttctacataatcgggagggtaaataatatcatcatctgtaagtacgatcatatcatttttagcgcaaggaaatataaatttgcccacatccttataatctttatctggaataactggatttaattttgaaaaaccatctaattcctcaggaatttcttcaaactcattcaggcaaagattaattttatctacttgagcatgtaaactttgtatagaatgcaccaactctttttttcgaggtgggtatgatgacatatttgcaacaatcatggggtaatattttaattaatattgcatgttaatgaaaactatcaacgtattgatagtcgtttatttataggaaatgcttaataaacagaacacattaagttgattagaatgactccgcacctcatggacgatatgtttaattaaaaataactactagggtgtacgtttgatatatttatcttcatctaaattattactcttaccatatcaaaccactctttgcataaacatttcctgtaactatctaaaaataaattggcagataattaattaaagaataacagcaacgtattacgagatcacgatcaaattcataattgcctagttcaaagtatactgtccatcctcctcatacactaaatacaatagagtttatataattatatagagtgtgattacaatctccggcaatgacactgttagtgcaacagtaatcaggcctccctcttagtattgcttacgctgaaagaataactggcagcctgccacaccatgttgtctggcaacgaggaagaccgccattttcggttcaaggctctgctgaaaaatagcgattttcctgtgtggcacgctgtctgcgtttctctgcttctaagacaccaattatctattctccaactactagtctaaaagactagtatcactactatcagttatttaaatgatattgattgcctagagattcagggagctagtctagttattcagagaacggtatcttaacaattttgttatgattttaggagatctggatttctattcatgatgcttggcgacaaaaataaatgaacaaaaagaacttatatcagccacagcaacataatttcttatgtcacttgtattctacctgtgtcattaagtttatcgtttcaatttcataagatacatatgctatttgtcatattaattttattattaacaccaacgaatgacaagcagaacatataaatacctgaactaagagttaattatttaatataattatcattcaatatctaaagcttgatacattttatactcatctataccactttgaacattctcataataaccaataatatagctatttttaaaaacaatcgccacatcacaaaactctttcaatgaattcaaactatgtgaaaccatcaaaaagctagactctttatgcctttctttaaacaattgagcgcacttctctttaaacctggcatcaccgacagctgttacttcatcgacgatataataatcaaacttaaatgccatgcttaaaccaaagcctaaacgcgatcgcatacctgaggagtaagttttgatcggcatatcaaagtacttaccgagttcggcaaattcttcgacaaactcaattttctctttcagctcttcttgcttcgcgtataaccgcgcaacaaattttacgttttcgcgtccggttaaacttccctggaatccaccggcgaggccgactggccatgatatcgttttattggtgatgatctttccgctatcggggcggtcaatgccaccaatcattctcagtaacgttgatttacccgcaccattacgaccaataaaggcaacgctttttcctgaagggatttcgatgtttaaatccttaaacacatagtgtcgccccgttggcgtacgatatgacttcgtcaaattctcaatcttaatcatgatgtcagcattgcctcctcacgagttcggtataacgccagaccgatgaacagggtgaccagagtgaacattgcaaggtagttcagactcacgccttcgctgatatagccaggcataactgcctcgcggcttaactctacgacatgcactaatgggttccagagtagatatgaccagtattgcttcggaatcgaatgtagagggaacatgatgcaggagatgaaatacagcggcttaagcagtatcggcaggaccttttgcatttcagggaaggttttaccaacgaccatgaatattaagccgatgccacatgaaagaatgattaacaaactccaggtgagcactagttgtaaaaagtttgttatctcgaaatattcacctgccatccagacgataagcatgagcaatatataaacagcaacgtaaatcagcgtctcaagcagtgcgcgtgcaatgatcgtatcgatgggttttactggtcgataattaaacaacccctggttcgcttcaatagcgcctacagaacgattgctgatactgctaaagataaaaaagggaatcaggccattaagtaaaaacaccgggaatgagatgtctggcatcgtgcggtgcataatgtaaccaaaaatgcccaacagtatcagcaaatgcgcagagggttcgagaatcgcccacaaatatcccagacggaacttaccaaagcgtgttcgtatttctcgtagaaataatgcctctacggtgactttctggacttcaaatccacttcttgccatttgatgatgtgatcc

SEQ ID NO: 14 - DNA, 37881 bp, Escherichia coli
  Nissle 1917, partial Genomic Island III
  ref <308>: DATABASE ACCESSION NUMBER: AJ586889
  ref <309>: DATABASE ENTRY DATE: 2005-04-15
gatcttactcgcacggaccgttgccggattgctggcgaatctcggcggctggcgcaccgtcttttgggttgcttcgatgttaatggcactgatggcgctggcattatggcgtggtctgccacaaatgaaatcagaaacccacctcaactacccacagttgttgggttccgttttcagcatgtttatcagcaataagatcagataaatgagcttgtcacaatacccagggtttgtgcattaaaacagacatccggtgatttattccagatggaacaaatcaaaaggaatcatccagagcttgtgttatataatggttacgatgaaatatttgcatcagggttaattgcaggtgcagatgggggaatcggtagtacatataatataatggggtggcgttatcttgaaatatttgaagcagtcaaaaacaatgatgtgattaaggcgaaggaaatgcaagtagcctgtaaccaggttattgacactcttattcagagtggtgtcctggcaggtataaaaactcttctttactatatggggattataaatactcctgtatgcagaagtcctttttctccggtaaaggaaaagaatctggatgtattatcaaaacttgcagagcgactgttcgaagaacatgacagaaacaaaaaaatgaaaataatctgaataattgcaagattgttatataggtgaaaatgaatgataacactggctgttgatataggaggaacgaaaatttcagcggcgttgatatctgatgacggttcatttttgctgaaaaaacagatatcaacacctcatgaaagatgtcctgacgaaatgacaggggctttacgtctactggtttctgaaatgaagggaacagcggagcgatttgcagtagcatcaacagggattattaataatggagtattgacagctctgaatccagacaatcttggagggctgaaagagtatcctctgaaaaatataatggaagatataactggtttaaatggaagtgtgataaatgatgcccaggcagccgcatgggcagaatatacagttttgccgaaagaaatttgtgatatggtttttataaccgtttctacgggggttggagggggaattgtagttaacagaaaattattaacaggtgtttctggattagccggacatgttgggcatatattgtccggagtaacggatacagaatgtggatgtggtcgtcggggatgcgttgaagcggtttcatctggtcgggccatcatgggggcagcaaaaaataaacttgcaggatatagcaccaaatatatttttgaattagcgagacagggatataaggaagcagaatttttgacagagcgttctgccagtactattgctgaattaatagtaagtttaaaattactgcttgattgtcaggttgttgttgtcggaggaagtgttggacttgctgatgggtatgttcagaaagtgtcgaaacatctttccatatattctgaaatttgtaatgtaatgctgtttccggcatatttcagaagtgactctggtcttattggtgcaactctttgggaccgggattgtattacttaaagtaatactccagtgtattataaatccgctattattgtgaggtttaatatggactcctgtattcagaaaaagcaggtttggtataagcatctttcacccagacagtggaagatattcggtgcggcatggacaggttatttacttgatggttttgatttcgttctgatatctctggttcttacagaggttcagcatgaattcggcttgacgacaatagaagcggcaagccttatttccgctgcttttatttctcgatggtttggggggcttgctattggcgctttatcggacaagatggggcgcaggatggcaatggttttaagtatagtgctattctctctcggaacccttgcctgtggtctggctcctggatatgcagtgatgtttattgctcgcattgttattgggcttggtatggcaggtgaatatggctcaagtgtaacatatgttatcgaaagctggcctgttcatctcagaaacaaggcaagtggttttttaatttctggattttctattgggggaggtttagctgcacaggtttatagcattgtagtaccactatggggctggcgttctcttttctttgtcggcatgcttccaatattatttgctttttatcttcgcaagaatcttccggagtctgatgactggcaaaaaaggcaacaagagaataaacccgtcagaacaatggtggatattctgtacagagaaaagaataaatacataaatattcttctgtcttgtattgcatttgcatgtctatatgtttgtttttcaggcgtcactgcaaacgctgctttaatcacagttatggcattgtgctgtgcggctgtttttatcagttttatatatcagggtatggggaaaagatggccaacaggcattatgttgatgcttgtggttatgttctgtttcctctacggatggccactgcaggcttttcttcctacatggcttaaggttgatatgcagtattcaccagaaactgttgctctcatatttatgctggcaggttttggctctgcagctggaagttgtataggtggttttatgggggactggcttggaacccgaaaagcatatgttatatcacttcttatcggtcagcttgttattatccccgtttttcttgtggaccgggactatgtatggttacttggccttctaatctttactcagcaggtttttggtcaggggattggtgctctggtgccgaaaataatcagtggttattttaatgtggagcagcgtgcggcaggactggggtttatttataatgtaggttcacttggtggagcatgtgcgcctattcttggtgcagttgttgcgtctcatacaagtcttggtacagcaatgtgttctcttgcttttatcttaacatttgttgttcttgtccttattggttttgatatgccatcacgtgtacagagatggatccatccagaagctgcgcttgaatatgatactgtcgatggaaaacctttttatggagcaagaaaaaagaatgttgcagaagaataacggatgctatcagggaataaaaaaatgattcattacagggagaatatatattctcttgataattatgagcgttacataactgacagttcgctatttgagaatactggcgatggcataatatatacaggtattgtgccccttattacagttgttgagcctgttgtatctaatcaacatagtgtgctgattatacctggaggtggatacaggaggattgtttatgaaagagagggacttgatgttggcagatggatagcaggtcagggatatacggcatttattctttcttacagaatgccctccgttaatggttattattcctttgcagatgcgaagaatgccctgaactttatttcttactgggccggaatgtcggagagaacatttaagagtgttggatgtatggggttttcggcaggtggtcatcttgctggatatattactcatctccattatgaggaagagacttctgtgcgtcctgactggatggctctgatatatccagttatatctcttgacaggagtattgctcatcagggatgccggaaacgtcttctggatgcaggtgaaagtgaatattcagccagtcttgaaaatagtgttacagagtatatgccaccagtctttattgtgcatgcaacagatgataaggatgttccagttattcattctctgagatattttaactctattcgggataagggacatcatgcagaagctcatttttttgataagggaggtcatggatttggtgtatccggaaaaaatggatatccgatagaaaaatggcaaagcctgcttctggaatggcttgcggaacataagtttcattgagaaatcaaattacaagtgataaatatatttaatgatgaggcatttatgaaaaaatattatccactattaactgtaattcttcttggtttacctttgtgctctcaggcattaactcttaatctacgtgggggatacagaagcgccagtcacgcttatgaaacgttgattcaggttagtcaggggtggaataatggttggtgggcaagttttgagtcaaacacctggaatacaattcacaacaatgaaaatgaattgtttgcactcaattataataaaatagatataaataaaacatataaaatagatgacaaatgggctctaatcccagggattcagacacaatggatgtcagcaggaagtcagtataacccttatctgaaaatttcgtatcaggcaacgccagatcttaatctggccttacgctatcgctatgactggaaagctttccgacagacggatttagatggcaacagggcgcgtaatgatcagcatcagtttgatggttatgtgacatacaaaattaatgattcatggttgtttgcatggcagaccacggtatatacgaaggttaataatttcaaatatgggaatcataaaaaaacagcaactgaaaatgcatttgttctgcaatataaaatgtcaccggtgttcaccccatatatagaatatgattacttggataaacaaggggtgtataaggggaaagataataaacatgaaaatagttaccgtgtcggtgttctgattaatttttaaaaggtgattacaatgaaagtgaaaaactttatatatcttcccttctgcttgtttattggaacgtcggtagccggagctttaccggaaattcctgaaccatttaaatatggtgtaggagggatcgagaatggtaaaatatatataggactaggaagtctgggaaataactggtatatgatagatacaaaccagagtgaaaaaaaatggactaagatagcgcaatggccgacagttcccagagagcaggcaacagctactattattgatggtaagatctatgtatttggaggaattggaaaagataaaagtggagtcataaccttacaaaaagatgtctattcctatgatattgctaaagataaatgggaaaaattgatgacccgtccccctgtatctcttgccggtcatgtttcttttatccataatggtcatgcggtatctactggtggtgtaaatgagaatatttttaatggatacttttcagatgtcgagttatcaaaagggaattccgcgctgacagagaaagtcaacagggattattttagtaaacctgctgatgattattttttaaataatcatataatttcttatgacccgtcaaaaaaccagtggaagaacctgggaacgactccatttccgggaactgctggttcatcggtgatttttgcagaacagcaaatttatatactgggaggggagagaaaaccggggcttcgttctgttagatcctggacgggggagctttcgcatgatcgaattaaatggtctgaacttccaccagtagcttcacccgagggggtgtcaggagcatatgcctctgttattgatggaaatatctttctggccggtggtgcatatttcccgggggcggcagaaaagtatagcaatggtgaatactggtctcataaaggactggataaagcctattcaaaagagatatatcagctaataaaaaatgactggaaaaaagttggttctttgccggaaggacttgcttatggtgtaagcctgccctggcagggggggatgctcattctggggggggagaaaaaagatggtaaagctgtttcagatgttatttatctgaaaaaaaatgacaaacaaataaagattgttaaataactgtaatgcaggtgactgtattagttgttcagtcacctgagttattttaatggggtttataatgaataaagatagatctttaaatgaaatgatgttaagcttgtttaataaatcaactattgttgacttgtcaagtgagacaatatctgagagtaaatctctttcaggccgtatttatcaggatcctgaacataacggggaatttgaacttgatcgtgtattgacagatatttatgctcctcagttaattatttttttaccagataaaccaaatggaacaggaatattgattattcccggggggggctaccaggctgttatgttagataaggaaggtacagctcttgctccagagtttttatctcagggctatacattatttgttcttagttacagattaccatcgccagttgagggagaaaatataaacaaaacttttattgatgcaatatctgcaatgctttatattcgtaagaatgctgataaatggcatctacagcgtcatcgtattggtgtattaggattttctgctggggggcatatcgcctcaacgtttgtgaatcagatttgtgatttcaaacgttcttctgacagtaaagaacaagagattttcgctattcccgattttgtcgggttaatttatcctgtaatatcaatgaaagatgatgtgacacatccaggctccaggaagcaattactgggggacaatagtacctcagaaaatataatacaatatagtgcggatcttaatgtcacatcatgttttcctcctgtgtttttactccattgttgtgatgatgatcttgtgtcaattgaaaacagtctgctcatgtaccgtggcctaatagagaaaggcgtttctgctgaaatgcatctctatgagaaaggagggcatggttttagtattcagtgggccacagatctttctgttggaggatggataaaactgtttatggactggatgtattctcatggatttaaataatatttatggtgactacctggtgaagcgtcgagtaactatgatgcttcaattcgtttataaaggtgattatacattagctgttcagctttatcacaatcatgctcttttatggccgtaagtatttcaatatgctgctgatgggtttttttgttattttcatatgtcattttattcttttccagaggtttggccattatcagccattcagaaaatgctgagtgtattgtttttaatactttattgtcaggtatatcagcaagtatactatgaaattcaatatcatattgagcatacacttcgggggttctcagtgagttatgatggatactgagcaccttctcaagcctgtgaatatcctcaggcgttgcattttttgctgcatatcttacaaggttggtttcaaaaaagatgcgtagtctttcaaaatccttgatgccatcagctgtagataaaaaatctttaacaatgcctgataacccattaatgatggtttctggtgatggacggcagacactggctttttctcccttgttataccggattagccctttatgtctgagagatgataaagcctctctgacagatggtcttccaacgccaaagaatgccataagttcacgttcagaaggcaggtattcaccttcccttatctcctcctggcggatcattctttcaagctcttcggcaacgatttctgaaagtttttttgtaacaatgggctttctggtcgttgttagcccgggtaacacggtttttttgttgtcggacatatattgatttatatggattagagcaaatgagtttttaatttaacactttcttttaataatgaaaatatttaattaaatctattatgtaaagggggaatgatgtatcatcatgattttaatgaaaaaataggtttctggtatgtgatagccctcgcaggacagtctaatggtatggcctacggtgaaggtattcccctgccagatacactcgacaaacccgagtcccgtgtaaaacaactggctcgtcgaaaaacaatcacaccaggaggaaaagagtgtaaattcaatgagattattccggcagatcacgcgctcaacaatacggtgtttttcgctggaggtcagacgcgcggtgcgcatgtcttccggaatatccagcggcaggtagagcgaaggcaacaccagttgcacggcttcatcccacgggttatcggtgccgtggccgtaccagatattcgccgcgctgaagcggctcaccgaccagcgcaacatgtcctgaatggtttgcagctcatttactgcttcatcaacgaaaattttatccacgtattcctccagggcatgatcgcaataatttcggcggctagtttgccatgaagatgacgataaatcagcattcacgcgcggtgagtgaggaaaaatacgtttaaaacgatcgattgtgctacgagtcgggtaaactgtaggaaaattagaaatagagaaagataaatgaaaaagaaaacaacacttagcgaggaggaccaggcgctgtttcgccagttgatggcggggactcgcaagattaagcaggacacgattgtccaccgaccgcagcgtaaaaaaatcagcgaagtgccagtaaagcggttgattcaggaacaggccgatgccagccactatttttcggacgaatttcagccattattgaataccgaaggtccggtcaaatatgttcgcccggatgtcagccattttgaggcgaagaagttacgccgtggcgattattccccggagttgtttcttgatttacacggtctgacgcagctacaagccaaacaggaactgggggcgttgattgccgcctgccgccgtgaacatgtgttttgcgcctgtgtgatgcatggtcatggtaagcatattttgaagcagcaaacgccactgtggctggcgcaacatccgcatgtgatggcatttcaccaggcaccaaaagagtatggtggcgatgcggcgttgttggtgctgattgaagtggaagagtggttgccgccggaattaccctgaatattaaaaggtggatgagtcgggccatttagccttggatactggcgtctcaaccctggcgataatgaacgtaataatcgggcattaattgaaaaacgtaagcagctttccgacagccttctgtgggctaatggcattgacccttcagaggggcttgaggatgacgacctgctgcaagcgcttatcgacgaattactcaccctcgtcgacggttatctggcacctttcgctcccgtgatggcgaatattctaaaaaactggatgaccgcatgacataacggacaacggggcctgatggccccgttgtgtggtgtatacgctacagctcgttgagcgtgtactggaagcggcaggtggaatcaatcggctggcggctgctggtatcgacacgcaccaccatgtcgtgcagttgcttgtcagtgatgggatgcctgtttggcgccaccgtaacattagcattatcacagcctgatgatgaaaacgtgatcatttgcgcaacccagcgacagtaagcgccctcttcattcatttgcgagccatcacatagtttgccgtctttcatcagataggttgaaagcgttttttcaatcacaccccccgtcgattgcaaagacagtgttttcgttttattgatatagttttcatcccacgaaacatcatacggcgtaactgacacggttgggcacacggacacggttgcatttggtccataatagatatctttatcaacagaaccgaccacaacctggctggtggctctgatactcactaaccacgggcagcctcccacatcaccatcgacggtaatatccagaggcagcttgagacattcccagcggctgtctttggcttccagtgcctccatgcccggacaaaatgaattatttacaattgtcccatcttttaccgtaatcgtcggcgcaggagaactgcccgttcctgtccatgtgcgattgggtaagttgccaagcgtcataacataattactttgataataggtaccgtagtaaacactcgaaacctcagcaacatcaagatacagttcgacctgactattccagccaaacgtagcatagtagatatacacattacgaaatgtctgccccatcccggcccgactaccgagcataaaaaccatcaggatcaaaagacgaaacagcaagttagtttttttcatcttatatgtactcaaacgttgcggttaaggaggcggtaaactcacccatcgtcacttcccgcccgcttttcgcctggagccaggcattaaaattcagattgttattgccgttactcagcacaaaggtcgcgccgctggtattgttaatcggcaccggtgttccatcggttttttccatgccaattccgacaccttgcgccgccgaagatacatccagcgccagaaagcccggctgttcactgtcttctgtaccggtcagcgtcacccggacttcatactgagctggccctttgcaatctttgagctgaaacaccactggcacccgcgcagactgcccggtcaccatcaggtctttacggctaacggtgggaaaatgcacctccgccagcgactcgccctgaacgactaacgtgcaggacttgctgagtaaattgccgtagaaatgcaggttgtcagccgcctgaacatggggcgtcagcagcaccgtcgccagtacagccgcgcagtgagatatccgttttaggttcattggtaatccacctgtaatgttgcgtaggcagaaaaggttccgtcgctgagcgccgcatcattggctttcaccggcacagcttgcagcgttggcggcgttgacgggtcaattttcaacggtgttcccagcttaaacggctggccgttttgctgtagctcaatccccaggccgctaacgtccgtttcaatggcggaatcatcataaggggtttggctgcccgtccaggtcaggctcatctcccaggcgtcgtcgcgcacatcggggtcacatgtgatggtgtaaggcacatcctgacggaaattatcgccgttaatgttgtcgataatgacgttgcgaaactcaacttcgatcgtcttaccatcgctgatagtacaggcgggtggcgaaaccagcgtgccgtgaaaagtaacgtcgttaatcgcggcctgcgccaggccagcaaaaccgtaaattaagcaccatgcgagtcgtttcattggtagtccaccaccatggtcatggtcgcattaaactccgatgccatcagttccacaccgctctgcttcaccggaacggcttcgaagtctggctgagtattgatgttgaacggcagccagctactgttacccactgccaccagcgaatggtcagcggcattctgaatacgaatgccaaaaccgctgattccagtactcagcaccgtttcgccgttgatggtcgtggtggtggcctgaagctgcatttgcaggtcgtcgctgacactgtttgagcagttcagggtgtagcccactgcctgacggtagttggcaccatcaatgcttttaataatcacattgccgaactccaccgcgcttccctttaccgaacagggcggcggtccatccaccagcacgcgcaacgtcagattgacgattttgccgcccgccattgccgggaaaacggtcacgccacaggccagcaatagcgcggcagatccggtcagaaagaacgctttcatgttgcttctcccgttatcaacctttgctgctttgatcttcatccaccttgcaggtgttcccttcacaacggaagatcagcggcatgcgcgcgccgtagtcgttgatataggtcagcaccggggcgctcgccatttttgcctttaacggttgtgacgttttcggtggcatcaccagcggtttaaacccggcggcagtcagccctttcttctgtgtgctggcatcgctgatgatgacgtggtacggcgtcgggttattgacggtatagtcctggccactgcgcgtgagtgtgaccttaaactgccacggtcttctcatgtcaatcttctccagcgcctttggtcgccagaacagcttgatgcgcgtttgcagcgcaatttgcagggtgttggctttcccggactttggcgggatctcacgcacgttgtagtagaacaggctttctcggtcggacggcagtgtgtgaatgtccggcagcgcctgaatcttcacctggccgttcatcatagcgtcaatacgctgcaccggcggcagtactgccagcggcgaagtgattttgttgcccttctcgtcttccagccagctttgcgccaggtaaggcagcttttcgttgttgttacgcaacgtcacgctgatcgatttatcgctttcgttaaacaccagacgggtgcgatccggggtgaccgatgcatgcgccgtcaggctggcggtggtaagcagtgccatcagcgctgtgctgacgagcattggacaggataatttataagacattgatcgttccttaatcagattattgagttgctgaaattgacgtcggcgcttccgttggtgtgacttgccgcgtctggtcctgaataacaggcttaatttctggcgctgaagaatcaggggctgccgttcccttttgttcacacggcaacaacagaccgctgaacaaatcggcaggtagcggcttcggcaatacgatctcgcattgtgcgctgccttcccagaacaccatcatatgctcgtccgcattgacccccgccagatagacattgccttcatcatccacaatgccaacctgctgctgctcgtcgtttttcacttccgcgccaaacggcgggtagctaccgtcacgcaaccgcagtaccgccatcgctttttgcccgctgatcactttgaatttacgatagccgattgcgccttccgtcagagtcgcctgcaccaccgactgggtggcttccgcatcttccggcaagttgtttaaatcgatatacgcctgattgcgatagtagttgttaatatcggcgaccaccgccttgccaaacatattggtgtacaccggcgcgccgttgctttcgaccggcacgttggcaatcccgtcggcgtcaatcagcaggcgcgtgccgcccatgttctgggtacggtgcagcgccccaccatgcgcggtcagcgttgccccgccctgtaaggcgatccccgccgaacggtattccccttcatggtagttggcgctgagatcaaccttcgccagcgaaccgtcgtggctcagataaccatccgcgctgccgtgctgctcgctggtgccaacgttaacctggtagtgcgttgcgtcatcgacgcgcttaaagtaaccgacctggctgctgtccgacccgctgccgtaggaaccgttgtaggtcacggtgctgctgtcgctccacggaatgctcatactgaggtacatccccttatccgcattatcgtcatattcgtagcgatagccggtcaccgagatgctcatgttgcgaatgctccccatattaaaatagtgggaaaacatcaggttatagtttgtctgttccgggcgatcccagtaagtacgatgggagtagttgagatagatcgaaacacccgcagcggcaaagttctggttataggtgatcgtatacatctctttgtcgttaccggtccgcgccatgtccgactggttcgcgtccagatactcgctcatggtcatgaagttcttttcggagaaacggtagcctgcaaaggtgacgcggctgttgagttcgtcaaagtctttggcatagctcacgcgaaaggagttgccgtccagttttcctttgccgtatgcgctgtcatgatccaggttgacgtgcgagtgagtcacatcgaacgccagcgcgccaaactgtgcgaggtcgcgccccacccccatcgccgccgactgatagtgtttatctgccagcgcaccaccgtagagcgaccagccatctgccaccccccatgacgcttctccgccggagaaaaagccgccttcggtcttgtggttccagtcttccggacgccccatcatcactttgtaacgcacctgcccctggcgcgtgaggaatggcatagatgcggtcgtaacgtcatattcctgcacctgaccattctgttcttcaacgcggacgtgcagtgtgccggagacggagtcgccgatatcctgaatgcggaatggcccggcgggaacctgggtttcgtaaagtacccggcccatctggctaatggtgacttttgcactgctgtgcgccacgccggaaacatccggtgcatagccgcgcaggttgggcggcagcatctggtcatcggtgctgacgctgctgccgatatagttaaagccgtcgaaaatatcggaattgagataatcttcccccagcgacagcttcgcttttaaagagggtaaggcccgccaggcgtaataacggctccagtcccagtttttgctcgttgtactgttactgctgtcatcgtcgtcatcgttgctgcgggtgtgctgataatcactttgccagtctgcacggaaacgccatgcccccaggttcgccccaacggtaccgttgccgctgatatcatgtgagtcctcgcccccctgctcctgatggcgagtttgcgcattgaggctgtagtcggcaatcaggccaggaataccgtcgtcccagcgtgagggagggtcccagtcgctgctggtatattcgaggtaagcctgtggcactgtcagcagcaacgccgactggcttaaatcattctcgacttccatcccgtctaattgacctggtttaaggcattcatcgttgtgcgtccactgcaggctttttgctatcccttctttcagccccagcgccgccactaactcaggtgtcaggcaggcatagttttttgttggatcgttttcagagacgtaccagttaatgtcgtattcatcagaaaggggttgtttatttataaatacacgtaaattatatttacccgcgtcgacataccctttttttgaaaacttaccgagatcaattttcgtatcgccctttaactcaaggaaacgggggtcaaattgaattgaatcatcagcccatgcattgactgacccaccagagattgccagcgcaatatagcaggcgattccccgcagccgaaaatttgagtgattaggcatacacatatccgtttgtgaaacagtcgtaaatctgttgcgtgttgaataaccccacagcagaacgctgtggggttgtcacatcagagataagtaatctggaatgtggtcagggtttcgaactggccgagatccggcgcatcggtttcacccaccagccaggctttaaagttcagcgtttgcttgtctttacccttgctggttgaagtatccatcacgattggctgaacaatcttttcgcccactttataacctttgccatgggtatcgccgattaccaggctcacgtggttcatggcaacaccgctgtcaacattgaataacgcatagttatccgtgttggctggccccgcgtagttagtaccggtgaacgtggtctccatgtttgtttcagtggtaaacacgcaatcctgtaaacggatctggaaatctttcggtgtggtagtgccaccgccggtcagtttagccgcaccgatgtcacccatatcgacttccagtttgtgatcgtctggaacgatagagcacggggagtcttcaatggtgccgtagaagcgcgcggtaccgttgttgcctgctgcaaaagcagaactggaaacaactgcgcccatgaccatcgccgcagcaatggctgttttggcaaacttactcattatttgtccttaaatcattaagagttataatataatcacctgacataaaattaatatatattatgcccgatatttatagttagccattgaacatatacactccaatataatcatagaatgtaaacaagtattctctggtgtgtctgtatgttggtcttatctataaaaaaactcaatttagtaatacttaaacactttatgtagattttattaattaatacatctacaaaatactttcaccactttccaacaaaaaaacatgcgaattatcaacaaaaaaacaaaccattataatcaacaaaaatgaattgcttataaagcacactaaaaaaattataatgaccttaccattatttattgctaaaatttaatattaattaaatcaataaatatatattcaagacacaaaaccattatcttctttattttattacgggattcaataatgggaaaatataataactatcgagagttgttaaatattaacaacatttagacaagaaaaagaatgattgtatgacggagaaactgcccggtgtacgcgcacgtaaccgggcattgattgcttaaattgcttttgccatcttcaaattacaagggctcatttgccagttgaattggccttttccgctttcatcaagcgttacgctggcaatcgctgaagtggtaaacataggcggcgtttcgcccggacataactcggcaaccagatacccgactaacggtaagtgagagattaccagtaccgaagcaacaccttcattggtcaacgcctgcaaataggcgccgaccagaccaacatcgccgcagggcgttaactccggcagaacttctgcactggaaggcaggttcagacaatcccctacttcttccagtgtttgctcggctcgcaggaacgggctcaccagaacgcgttcgatttccactttttgacctttcagccagttcgccatcaggcgagattcgtcacaaccgttagtagtcagaggacgaaccgaatcactggcggcatcgagggctgcgtcgccgtgacgcatgataaaaacttgcatattgcaccgcttttgttaaccagattcgcccgttttctttcatctgaaaccagagaaagaaaacggtggccggcattgtgccttatccattcaccgaatgaaacgctgttttttacctcaatggcgtaagtatagtcaatatgcgtttacattttgagcaacactccgccattcagcgcggattcatatagctttgaccttcttattgcaggtcagttgcagttgttttccaaaaactttccccacgcttgctcatctcgactaaacgctcgcaaggggtaaaacgggaaccatactgcgtggccagtcgttgcattattgcaaccacttcgcctgcgccgagagaatcgatatagcggaacggtccaccgagaaatggcggaaaaccaatgccaaataccgcgcctatatccccgtcacgcacgctacggataacctgctcgtccagacaacgtactgcttcattcagcatcaacatcacacaccgttcagcaacctgcggtgcggagagtcgcccctgcccttgtgcgccaatgagcgggtaaatggcgggatcgacctgttttttgcttttacgccctttctgaccataaagatagaaaccccggccattttttctgcctttgcgatcgtcgttcaaaattgaagaaacaacatttgcaggcgcgctaaaacgttctccataagcggcttccagtacaggaataattttagtcccggtgtcgattcctacctcatccaaaagttggattgggcctaccggaaaaccaaatttcaccagcgcggcatcaatgtgctctacccgttcaccttcggtcaacatgcggatagcttcattaatgtaaggcgctaaaatgcgattgacgtaaaacccggctttgtcacgcacgacaatgggcgttttgccctgttttttcgccagttttactgtggtagcgatggtttgcgccgatgtccccgcatgaggaataatctccaccagcggcattttttccaccggactgaagaaatgcaggccaataacttgctcaggtcgcgcggcgtgagcggcgatatcggcaatcggtaaagatgacgtattcgaagcaaagatggtatgagcggcgcaattttgctccacttccgccaccatctgttgttttaattcgagattttcaaacaccgcttcaataatcagatcgcgatgggcaaagccgcgatagtccgtcgttccggagattaatgccagctgtttgtcacgttcgctggctttgagatgacgacggcgaactttgccctccaactgatcccagctgtacttcaatgcatgatttatgccctgcgggttgatatctttaattctgaccggaagccccgctttacaagcagtgacataagcaataccgccgcccatcaagccaccacctagaatccccacgctgtttaatggcgcaggcggcgcatcactgccgggatcttttttcacttccgtactggcaaaaaagatattgcgcagcgcctgtgattgcggcgtcatcgccagttcaccaaacgcccgagcttcggcgtcatagccactgctggtcccctgcgctaaaccggtttcaataacgtcaagaatgcgtttcgtcgctggatagttaccctgagttttttgctctgttttcttgccgaccattttgaacagcagcgcacgacctaacggccccgccagaatacgctcgcgtacaggtagagggcgtgaagatggacgatcctgctttgccagctcaacagcggcttccagcaaaatggagtgcggaacaacgtcatccaccagccccagctttaatgcctgtttcgcccgaagttgttttccggtgaggatcatctctaatgctgtgctgacacctatcaggcgcggtaaacgctgggtgccgcctgaaccgggtaacaatccaagttgtacttcaggcaaaccgagtaccgttttaggatcatcagtacacacgcgaccgtggcacgccagcgccagctccagcccgccgcccaggcaagcgccatgaatagccgcgataaccggaacgggcaaagcatgaatctccgccattaactgttgaccctgccgcgccagtgcttccgcttcttgcgccgttttgcagttggcgatcatattgatgtctgcaccagcgataaagttgtccggtttcgcggagataaacaccacaccgcgcagatctttattttcgcggagttgtttaataatggcgcgcacctgcgaggcaaactccgccttcagggtattcattttctcacccggtacgtcgatggtgataacagcaatgttgtccagacggacattaagggtaaacgctgatgccatttccattattccgcctccacaactattgccgcgccaagcccacccgcagcacaggcggtcactaatccaaatccaccgccgcgacggcgaagttcatgcaatgtctgggtaatcattcgcgcgccggtcgccgcgaagggatgcccgtaagcaatcgaaccgccaagcacgttaaatttgctatcgtccacttcgccagtggcatgtgcacgccccagtacatcacgagcaaaacgttcactacccagcaactgaatattcgccagtgtctgagctgcaaaggcttcgtgcatatcgatcaatgtcagatcgctcattgtcaaaccggcacgttccagtgccagcggcgttgaccaggccggaccgagcaacatgtcctgccagacatctatcgcagtaaatgcgtaactgcgcagataccccagcggtaccagccctaattctttcgcccgcgattcggtcatcaggatcaccgccgctgcgccatcggtcagcggcgtactgtttgctgccgttaccgtcccgtgtttacgatcaaacgccggacgcaactttgcgtaatcagcaagcgaggaattaccgcgaatattgttgtcttcggcaagcggttgtttataaggagggataaaggcagtcatcacctcttctttgagtttaccgtctgaccacgcctgagcagcacgctgatgcgaacggtgcgccagtgcatcttgctgttctcgggtgatgccgtaggttttcgccatttgctctgcggtgtcccccatccgcaagccggtagaatactctgctaccgcaggcggtacgggcattaagtcgcgtaaacgcaggcgagagaagagtttcaggcgctggctcattgtgcgggctttgttgacatcaaccagtacgcgcgccagttttttactgacgccaattggcaatacggaagaggaatctgccccaccggcaatccccgcgcgaatagttcccgccatcaggctttctgcgacgtttgcaaccgcctggaaactggtagcgcaagcgcggctgacgctgtaagcatctgtatgcacattcattccagtaccgagaacaatttcacgcgcaatgttgggggcttccggcatttgtacgacctgaccaaagaccagttgttcaatcacttcagcggggatctcgctgcgtgccagcagttcgcctaccaccatcttccccaaatcaacagcaggaatgccatgaaaagccgtcgcctggcgggcaaaaggcgtacgtaacccgctaacgatggcgatacgatcgccctggcgggtaaccagcggtaaaacctgacccataacactcccctgtaaaaaaataaataaagtggtctgacctgatcatagtcttaaccatttttttacatttagccaagcggagaaaaaggaaagtgggagctatgacacagtgaagacaggagaaagaaaagaaaacacccctgccagcaactgacaggggcatacgtacccgagaggaattaacgcagacccagctggaagatcagcatttcagcttcgcaggcaaaagtgaaatcgatatccaggcgcacaccgtcagactcttcagtgaaagtcggggtgattttgcacggttcggattccacgctacgggctttttcagtcagcgccgccagcgtttgttctgcttctgcgcggtttgcaaacacacggctgtaagacgcggtgcagtcggagttgtccataatggtgccaacatccatacagcagcaaaccggggtttcatcagcactacatttactcatcgttgatttcctctgtatgtgcacccaaggtgccagataaacgttgtggatattttacgcttccggaaagtgctgctccagttgttaattctgcaaaatcggataagtgaccgaaatcacacttaaaaatgatctaaaacaaaattcacccgaatccatgagtgcgccacctcccaattttgccagctggatcgcgtttcttagatcatatctgaaaaaagatagaaacatacttgcaacattccagctggtccgacctatactctcgccactggtctgatttctaagatgtacctcagaccctacacttcgcgctcctgttacagcacgtaacatagtttgtataaaaataaatcattgaggttatggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggtgcaattgccgatgatgcaggtaacgttagccgtaaccccgcattgattaccatgtttgaccgcccgacattttctgcgggtgcggtttatattgatccggatgtagatattaccggacattctgatttaaccggtcagagtgcaaatgctaaaaatatcgcaccgacagcatgggtacctaacctgcactttgttgcgcctattaacgatcagtttggttggggagcgtcaataacttccaactatggcctggctacggaatttaccgacaactacgctgctggtatctatggcggtaaaaccgatctgcaaacaatcaaccttaaccttagcggggcttatcgccttaacaatagctggagttttggtcttggttttgatgcagtttatgccaaggcaaaaattgagcgttacgccggttcgctggggccattgttgtctcaacagttgattgcccagggtgtacccgcttcattaaccaatggtattaatactccggactctcaaattgctcatttgaaaggtgacgaatggggctttggctggaacgcgggtattctttatgaactggataaagataaccgttgggggctgacatatcgttcagaagttaaaatcgacttcgatggggattacaaaagctccattaacccaaatctgaacaatattttgggtaacatgggcttaccgtatggcacgatgggggcaacccaaaatggatccttaacgctgaacctgcctgagatgtgggagatttctggttataaccgtgttgcgccgcagtgggcaattcactacagcatggcctataccagttggagccagttccaggaattgaaagcgaaaggcgatagtggtcagactctgttctataaagatgaaggattccgggacgcgtatcgtatcgcgttgggtacaacctactattatgataaaaactggaccttccgtaccggtatcgcttatgacgacagcccggttccggcagataaacgttctatttccattcctgaccaggatcgtttgtggttaagtgctgggttaacctacgcatttaatgaagatgcatccattgatgttggcgcatcttatatgcatggtcagaaagtgaaattcaccgaaggtgaaggagcggcagcttattccttcgagtctgaaggtaaagcctggctgttcggtactaactttaactacgcgttctgataacgcgttagcttaataagaaaaaaggtgagttttgcgactcaccttttttgtttgtttcttattcagaatcgatatcttttaaatcatcctgaatcgcttgcgcgttcggattttcctgcggtttgagttcaccgccattagcgatgaaatcatgacgctggaagtacgcttcacgcaccataatataaggatcggaggactgacgcagcagaccgtcggaatccaacaactgcgcacgagtttctatcccttcaagcgtccatttacccacagacatcggccaggtcagccaggaaagaaccgggtaaagactatccgccatatcaccaccgtcatcacgcagcgtgaagctaccgtagaacggtaactgaacgtacggcccataacccacaccataatgaccaagcgtactaccgaagcggtgaggttcagtccgttgcagtttcgggttcgccatccctgcaacatcaataaagccgcccattcccaaaatggtattcaggaaaaagcgggtaaagtggaccatcccctgataagggtcgccctgcaagaagtagttaaccatcaccgcaggttcttcaaggttgccggtaaagttgctcaaaccgttacgcgcaggttgcggaacataatcacgccaggcgacagcgaccggtcgaacaatatacgggtctaatacattgaagttgaagttgtacatagtgcggttaaacccttctaacgggtcagaacgcccttgctgatctgtaccggaactcgcacaccccaccagaagcgtagttcccagagcaagcgccgacaggcgaagcttcataaatgtctccctgtttttttatggcttatgcagtttgccatccatgacggaacgataccgtatccgcctgtttaggtgtgggcgattgtaacagcacgtcaactgatgtccagacgccctgatttgctgatttgatcatagcctggtaatcgccgccctgtaggctacttgattctatagaaacagaaaaaggcaaacgcggccttttctacattttcagagtaactcccgccagttgcgagcaaaaaagccgctacgctttagctatacgtgctaattcaagagaagagaccatggacaacgacaaaattgatcaacacagcgacgaaattgaagttgagagcgaagaaaaagagcgcggtaaaaaaatagaaatagatgaagaccgactcccctcccgggcgatggcaattcatgagcatatccgccaggatggtgaaaaagagctggaacgcgacgcaatggcgctactgtggtcagccattgcggcgggcctgtcgatgggcgcttcgctactggcaaaagggatatttcatgtcgaactggaaggcgtgccgggcagcttcttgctggagaatctcggttatacctttggttttattatcgtcataatggcccgccagcaattatttaccgaaaacaccgtaactgcggtactacccgtcatgcaaaaaccgacaatgagcaacgtcggcttacttatgcggttatggggcatcgtgctgctgggtaatattatcgggacaggtattgctgcgtgggcatttgaatatatgcctatcttcaatgaagaaactcgcgatgcatttgtcaaaatcggcatggatgtgatgaagaacacccccagcgagatgtttgccaacgcgatcatttccggctggctgatcgccactatggtatggatgtttcctgcagcgggtgcggcaaagattgtggtgattatattgatgacctggcttattgccctgggtgacaccacccacatcgttgtcggttctgttgaaatcctctatctggtgtttaacggcacgctgcactggagcgatttcatctggcccttcgcactacctactttagcggggaacatctgcggcggcacctttatcttcgcgttaatgagtcatgcacagattcgtaacgacatgagcaacaagcgcaaagtagaagcacgtcaaaaagcagaacgtgcggaaaacattaagaaaaatgataaaaacccggcataaatggcgagggtttaagcaatcgagcggctgtgtacttaccccgtagtccattagcgggtatactcatgccgcattgtcctcttagttaaatggatataacgagcccctcctaagggctaattgcaggttcgattcctgcaggggacaccatctatcatccccctcgcaataacccacttacaatcagtgagttatcttaaaatccttagtatagtcaaccagtacttcgatatgtgaacgcaaatcatcatgcattcgtgaacttaactggaaacctcccccattcgatgtcaaaatgactaccccaataagttgccaataatcaggctaatcaatacgggtcagtcttgctggtcagtgaccataaaaatgtcacctcatattagacacagcaaataattgtgtcgattaaacatactaccttcagcataaccgttcctgaaaaattattatattcagtaatctgaataaattactggcctgctatttttcttagcaaccatatttagcagcaagccagcaaatctgaatgattacagatgctggcctgctgaatctcccttctggaaatcgtcagaatctagtgattacttactttgttctggtttctcttcattcttattgtgcacttccactttgggtaactgattaaaaaccagattttctttttcaaccagagccatgacttctttggtgatatcagctgactcgttatgcgcaagcacaacacctgaagacaatacagcaatatttttaggattgtcttttctccatgtacctatggcattatctatcgcacgggataacaccatttttgcgctattttcctcaataacacattgtcgctccagtttttgtctggcatcaagaagcagcgcctctttattcgcgttatctgcgaatgctttttgcgcatcctcatagcctttttcaagaatactcttaacctcattcagatgctttctgaccatgtctccggcggcagactgattataaatagcatcgatattaacaactgcaatttcttttgactttttcatataaaaaacaccagtaagtacaatcagcaacagcagcactactgcattaacaacagaaaatttcattacagaactcattatgacaaccctgaggtggcaggaggtcccctcctgccactgtgtgattagaatatatatttaatacccagcattgcctgggcatcactgtaccctttatcgccagcctgaacaccaacattgccccagacattcaggttatctgacaatttaccctgaacacccgttttgacttcagcaatatttgtagctccgtcctgactgagtgccgtattatccattttgacaccccagctccgtgtattatggatccagttaacttccacaaatggctcaaactgatgcgccttattatcatcagacgcactcttacctttcaggtaagttctgacgcccagacgactctggatattaccgtctccgctgagctgaactttcgtgccattcttctccgtatgctcactggctcttacattcatccacgtgatctgggactgcggctgaatataccagtcatagtgactaccctggctaccggtaaattcgccggctttaaaggtataacccgcttccactgaaccggtaaatccacgggatttccaggactccgcagccagtttttcaccattaacggtattattaaaccatccgtactggatccaggtatcgacataagccccgttgtcattaccgtcattctgctgccacgttccgtataaaccggtgctgtatccattgatcgcacctttagatttatatcccgaaagcgaggatgtcgtggaactcttctcatttccataaccggccataatcccctgttgcagacggtcctgaccgtcagtccattgcgcaatgctgccacccagttgcacaacataacggttactttgcgtattcagctgtgaactgctgtccttccagcgattatgaccgccgatatgacgcatccacatacttgttgctttcttctcaccagtaaacacatcggtatagtaagtttccccctcacgatcgtgcattctgatgttgaacagcgtgttggctgccgctatgttcgcaatataagagcccgcttccggacgatagaccttctgtacaggtttatccggcgtggggtgtggctgtggctgcggttgtggctgcggctgcggttgtggctgcggctgcggttgtggctgcggctgcggttgtggttctggcggcaattcagaacgcagataccagttaccgtcagtaccacccgcattacctttatgcaggaaatattcccacgcccctgccaccgcacggttctgcagtctgaagttaccgtcagactgcccaccgacatgcacaatctcaatgccgtcagcggtctgagccccctggccccggacattattcaccaccacgccggtatcaccggaggtgttacccgtgacaatcagtttgtcagtggtagaagtatcatcccccagcacggtattgataattaacgtaccgccaccggtgtaatcgccatttacggtcagggtatttcctgtcttaccaccggccagacgaatgacgccggtattggtcagtgagccaacggtaaaattgcccacctctgccgtttcataacctgagagagcattcagtgatgccagtgttccctggttattaacctgacccgaaacggtccccagcccactcagtgtgccgccattaagaacatgaatgtttttggatcctgacaacgtcgcgccagcggcacgggtgactgaatcatcaccgacaatcagaacgccactctcaaccgtggtatcaccggtataagtcagctcatgattaatgatcagattacccgccccctgtttcaccagagcgccggagccagtaatatcattcttcagtaaccagtttccactggcggtaagccaggtgacaccatcactgtcaatcagcccggtgcccaggtgtttttcatctgaagcccgcagagcagcatctttctgcacacggaattcaccgctgaaattactgttatccccggaaagcgtcagatcagtggtgttcagtatacccactgaaccttctccggaaagcgatttactcaggttactgctgactccgctaccgtcggcgatatcaatcgccaggcgatcattaaggctttcaaagctgatggagccctggcttcccagcccctgtgcgccgttcatttcaaccagcgccccctgggtaaggctggcattaccggtaaacccgatattggtgccatgtaccgtcagattgctgcccgtgacagccagcgttccctcaccggacagcacgttgttttcaatgatgccaccattatcatcccccggctgacgctgcgtgccgctgaccgttagtacactaccgctatcaagctgaatgtgcgctcccgtttctgtctgcagtgcaccgacagtctggctgtatccgtttgttctgaagacggcattgctggcgacgttcagattacctgttgcgccaagtacattatcatttgccatctgtaatgtgccgctgcgcaccagcgtatccccggtgtagttattaccgccgttagacagtgtgacaacctgccccgcagcttcgatggccagatcccctgcccccgttaactgtgcgccaagatctgtctgcagtccctgggcattcgctctcggtgtcagcaccagcgctttatcaccggttccctgtaaatccagcgacttcagcccatagcctatgtacagtccgtcacctttaataccgtcggagcttcccagcagcttatagtcataatttccctgagctacaacttcaccgccctgagtgacatcaaacgtctgactgtgagaaatagcctgcccgttttcatccaccagttgcagttgcccgccagtaccggtgacggtacccgctgcattcaccagcgtgaccagggtctgcgcatcatcctgctccagcaaattcttacgggtatcaacagccggaatatcattaatcacttcatctggcatggtgacctgaattgtgcctttcccccggatatccagcgtacctgcagcagaggtttcaatactgttgctggcaatggtatcgcccggcataacggaaccaaaaatcagcgttccgccattgaacccaagaccgccaatctgctgaacaccggagccaaccgttgtgatattcccggtttcagacatcagcattgcatgggttaacccgctcgtattcagcccttccagagcaaagctactagtacccagcttcagagttccggcaaattgatccccgacgttatggctgaattcaaaagcagatgtgtcggcatcaagacgggcagacagtgttcctttgcctgttaacagtggatcaaaggtaaagttgcctgcaactgcgggaataatggccagttcgctgcccgattcaatatcgacggaacccggaccgttccccccatcggtcagcacaagagcttccttcagagtgacaagtgaactgttcttcagcccgacatgttcgaaattctgtagttttacaacagaatccagcgtatgaatggcgttatcaaaaatcagggaatcagaatctccctgcccgccatccagcaggttccaggttgccccttcacctttaatggtgaaggtgttcttcccggtaccggcagtaacctgatcaacatgagtcttaccattgagtgttacattattattgccatttcctgcagtcacttctcctgtcagtgtgctgccatcatcaaataaaaatgtattgttaccctctttcgcactgacggttccggtaatactgcctttattggtgaatgtgttatcaccgccgttcagagccacaaccccctgaatttcagcaccgctgtcattcagtacggtggtattcacggcgtcatcaaacgccattgcagtcccggtggtggacgcagctttaatctgacctttattggtaaaggattgtgcttttgaagcatccactacggcatgactcagagaagcagagatgagattaccgctctgaaccacttcactggctgcattgttaaccaccagagcggaaccgccatcggcctgtataacattgacacttgcaccactcttcacgacagcaccatctttagtgttggcgaaaatacccgtgccgtccgtacccttcaggttaatgaccaatccagcggagtcagacatatccaggttattatcggtttcacttccgtcagctttctggaacgccagtgcaattccactgccgtctacattaatagtgccgctgttggtcttggccagggaggcagaagtacgtacaccaatgccatcagccacattaatttcagtcgtattggttaactgaatgccttcaatttctgcgcggttctcaatcccgtgaccgaccgcacctgcagcattaacattgattttcgcaccatcaataaccagccccacagcccctgtatccagcaggatgccatgcgcatttttctgaccttcgatcgtacccaagccactccctgccaggttcagtgacgcgcccgcccccagcttaatggcagcctcaccatccacagcgacgatatcccctcctgtgctggtaatctgagactgtgcaccttcaacaaataatgcaacgccattgaccgcaatacggcttcctgtattttcaaagcggccgttatcaacccagacgccgatattatctgtaccggtagtgaaatcaatgttgccgttgttaatcaacagtccctgattacgcgtaataaagcccttggcattattcagcggcgaagagatatctgcctcattggtaataaccgagccagtattcgtttgtgtaatactgccatccagagcgtattcatttccgtcaacttccgcgacaacagcgccatcccctacaaggttaactgatgccccctgtttcagcgtcgctgtcgcaccaccagttacatataatccctgagcctgagcgcccaggatctggaaatcactgccagcatcagccaggacattgctccctttccctgtggcccagataccacggctgcctgtcccggaggttttcatcagcagagagccggcctgttttgccccatcttcaatacggaaaagtacagaacgttccccactggcatccagcagagttcccggtgcaatattcgtcttaatggttgcaccatctccgataatacgaaaagcaatctgatcggtaataccagagccgtcagcagcaaagttcggtactgccgaaccatcaaggttaacagtccctttattgctggcctcaacgccaatcgccccctgtccctgcaaagatatagtacccgcggtcatattaaccgttgttgttgtaccagatgcttttatacccgttgtacggttagcattatctcctcccttgagaacgagatttcccgagttattaatcgttgtaacatcttgtgtggcattagcaattagtcccacaccaccatcctgaactgtaatatttccgctgttggtaccaacagccccctcctcaacccggacgcccactgtattctttccagtaaagatgatattaccggtattatttagagtggccccattacgggcgatatacccggtcactttatcctgggtggaacttaactgagcccccgccgttaatagtgtggtcttgtccttcggattaatgagtttgccggaaatatcatagccattgccatccgcaataccggctatcgcactggcattatccatattgataatggcattactttcaattgtgccctgcgctcccccttcaattaaagtcgctgtagccccctcacccgtcaggttgatggtcattcctccagacgttactgtcgaggccacaccgccatccgatttccccgtggcaataagtgcataagagttcttaccagacgccgtaagtgcagaagaagcatctgcagttccctggaatgtcgcaccactggcaatacggaataatgttgagttttcagtggacacatccataacaccgcttccggtattatgaatggcagagtcctttccatagacataaaagcctatctgatcacgaccccaataatcatcgcggcaattaccgcatagcgcggcgcaacggccctggttgccagccataccagcaacatactgccacacaacgtaaattgaccatccaggctcgcaaacgcctgtaaaccaaagcgtaataaaatcccggcaagcattgccgccgcaagcgagtgcggaataatgcgcatcagacgagcaaagagtcccgttatgccgcagaggactattaacacgttggtgacaataaaaacgccgatggcttcgttaagtgttagtccctgtaatccggtgaccaacaaagccgcgccaggcgttgaccatgcggtgagaacaggtacgcgataccataatgtcagagtcagcgtactgacgcccattgccagccccagcgccgtcatccagccagagatttgtgcagtggtggctccggcgacaatcgctgcttgccagattattgccgctgaactggcgtagccaattaataccgccagaaaccccgccagtagcgtgggtggaggaatagaaaacagacgcatagtcacctcgtgcgttataacgtacaggtaccgtagcatttgtccgttataacgcacaagtgataaacttccgttttgccggaggagtcgcatggaaaatctcgctcgctttttatccaccacacttaaacaactacgtcagcagcgcggctggagtctttcgcgactggcagaagcgacgggcgtttctaaagcgatgttagggcagattgagcgtaatgaatccagcccgacggtcgcgacattatggaaaattgccaccgggttgaacgtgccattttcaacatttatttctccgccgcagtcctctacgccttcagtttatgatccacaacggcaggcgatggtgatcacttcgctgtttccttatgatccacaactctgctttgaacacttctcgattcagatggcacccggtgcaataagcgaatcgacgccccatgaaaagggggtaatcgaacatgtcgtcgtcattgatggacaacttgatctgtgtgttgatggtgaatggcagagccttaattgtggggaaggcgttcgatttgctgcagacgtcacgcatgtctatcgtaatggtggggagcaaaccgtacattttcattccctcatccattacccgcgcagttaagcgggaaaactatttcgcaacgtcgcgcttgtggctaaaatagccgccatttttcagctactggataagaaagtgaccgtatcttctcatcgtcttgaactgttaagcccggcacgcgatgccgccattgcccgcgaagctattttgcacggtgccgatgctgtttatatcggcggccctggttttggtgcccgtcataatgccagtaatagcctgaaagatattgccgagttggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgatattcgtacagtagaaaaagcgaagttcctctctgatgttggcttcacgcagattgtgctggcgcgagagctgaatcttgagcagatccgcgcgattcaccaggccacggacgcgaccattgaattctttattcatggcgcattgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggcgtacgctccttcaagattgaagggcgttacaaagatatgagctacgtgaagaatatcaccgcccattatcgtcagatgctggatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtgggcgaagtattgaaagtagcgaaagatcatattgatgttgccgttaccgagccactggcaaatggcgatggcctgaacgtgatgattaaacgtgaagtcgtcggttttcgtgccaatacggtagagaaaaccggagaaaatcagtaccgcgtctggcccaatgaaatgccagcagatttgcacaaaattcgcccgcatcacccactaaaccgaaatcttgatcataactggcagcaggcactgacaaaaacctccagcgaacgccgggtggcggtagacattgaactgggcggctggcaggaacaactgattctgaccctcaccagtgaagagggtgtcagcatcacacatacgctggacgggcagttcgacgaagccaataacgccgaaaaagcaatgaacaatctgaaggatggtctggcaaaactggggcaaaccatctattacgcccgcaatgtgcaaattaatttgccgggggcgctgtttgtaccaaacagtctgttaaaccagttccgccgtgaagccgccgatatgcttgatgctgcgcgtcttgtcagttaccagcgcggcagccgtaaaccggttgctgatcctgcgccggtttatccgcaaacgcatctgagtttcctcgcgaacgtatacaaccagaaagcgcgtgaattttatcatcgctatggtgtgcaactgattgacgcggcgtatgaggcacatgaagagaagggcgaagtcccggtgatgatcaccaagcattgtctgcgctttgccttcaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgatctgctgaaaacattgccgaagcgaaaagggtaaaacgccagttttcgggttactcaccactcatcaaatctgcatgatattgcctgccgggtaaggtgtcacgccgcatccggcaacacacgactcaacgctgtcccgcttctggtttgcgcgatttttgccagtaaaaatgctcgcgcaaaccttccgccgactcttccgccacagcacgcaattcatcgctgtccgcttcatgacgcaactgatgatccacattctttacccacataaattcatgtcctttgtgccctgccatgagttgtcctgagaacagtgcacacgttaataagacaaccgataacgccttcgaaaacatcccgccacctttttctaaccttttgccgctatgatgccgatcgtttcttgaggttattattcagttttgcaaattagagcaaagaaattctggaatcttccttcctgattttgcattgcattctgccgttgcggcgatttagtgctattttcgagcacattacacacggaggtaaacttcgccattaaatagtcacgatcactttattgaagtgcctttgagcgtcgcctctaaggtattgctgttaaatgcttttttacagtcagaaatcactcagcaagagttagcccggcgaattggcaaacataaacaggagattactcgcctatttaatttgcaccatgcgacaaaaatcgacgccgtccagctcgcggctaatgcgcttggcaaagagttatcgctggtgatggtttgattacagttaatgaaaagttgtcatttttaacaactgatatagactgccgaatcatctgcacataattacgattcgataatgaaaaaataccagcagcttgcagaacaattacgcgagcagattgcgtcgggtatctggcaacccggcgatcgtttgccttcgttgcgtgaccaggtggcgctttctggcatgagctttatgactgtcagccatgcctatcagttgctcgaaagtcagggatatattatcgcgcgaccgcaatcgggttattacgttgcgccacaggcaataaaaatgccgaaagcgacagtcattccagtcacacgagatgaagcagtcgatatcaacacctatatttttgatatgttgcaggccagtcgcgatccgtcggtagttccgtttgcctcggcctttcccgacccgcgacttttccccctccaacaactaaaccgctcgctggcgcaggtaagcaaaaccgccacggcgatgagcgtgattgaaaacttaccgccaggaaacgcagaactgcgtcaggctattgctcgtcgctatgccttacagggcatcaccatttctcctgatgaaattgtcattactgccggggcgttagaggcattaaacctcagtttgcaagtggtaactgaaccgggcgattgggtgatagtagagaatccttgtttctacggcgcgttgcaggcgctggagcggttacggctgaaggcgttatcggtggcgacggatgttaaagaagggatagatcccaaagcctggcatttcgctttcgctgaatcggcgggtcgcgccgagagaggctatattcccctcttttttaaaggcgtccggaataatgcgctggcagaatttattcaataccgggccgcaaagaataaaggttggaatgccgacaatgataccgtatatcagtaccaatcctacatcagcgccatattccctggcgataacagtcgggccggggtgcggcggcaaaaaaccgtgtgcgaccagcaaaccagaaagcatcggcacacacataaacatcggtgatatttttgcttcacgggcaatagcgaataaaataggtaccagaagaattaaaccgacttcgaaaaaaagtgcgataccgacaataaacgccgaacagaccactgcccagtcaagtttatttttcccgaaataattcagcatggtcagcgctattcgctgcgcaccacccgcatcggccagcaagcgaccgagcataacaccgaagccaaatatcaaaccaatatggcccagcgtaccgccaagcccggattcgactgaggtgacgactttactcaaatccataccactggcgatggcgacagcaatcgagacaataattaacgaaacaaacgtattaagcttaatttttatggttaaaagcaggagtaaagcaatccctgccacaacgataattagtggcataacgtcctctcataacagggtagcgacccatcattatccgactgagcaaataacgaatgatgcagagtcggataattcaggtgtctggatgtttttatttatgctttcagtttttattcataaaatcgcgcaaagccgcgccaattttgtttacatcataaatacaaccggtccatgtcccgccactcacggcctgaagcattgcccatagctgggtatcatctggcaattcaggatcagaactggcgcgataacctggtgcgccaggtgcagcattcacagctggaactggtggccaactttgccgatatctcgctacgcctgtcgcagattttaaaactgaaacccggcgacgtcctgccgatagaaaaacccgatcgcatcatcgcccatgttgacggcgtcccggttctgaccagtcagtacggcactctcaacggtcagtatgcgttacggatagaacatttgattaacccgattttaaattctctgaacgaggaacagcccaaatgagtgacatgaataatccggccgatgacaacaacggcgcaatggacgatctgtgggctgaagcgttgagcgagcaaaaatcaaccagcggaaaaagcgctaccgatgcggtgttccagcaatttggcggtggtgatgtcagcggaacgttgcaggatatcgacctgattatggatattccggtcaagctgaccgtcgagctgggccgtacgcggatgaccatcaaagagctgttgcgtctgacgcaagggtccgtcgtggcgctggacggtctggcgggcgaaccgctggatattctgatcaacggttatttaatcgcccagggcgaagtggtggttgttgccgataaatatggcgtgcggatc

SEQ ID NO: 15 - DNA, 29 bp, Bacillus megaterium
  xylA gene promoter: basepairs 1790-1818
  ref <308>: DATABASE ACCESSION NUMBER: Z71474
  ref <309>: DATABASE ENTRY DATE: 2005-04-18
ttgaaataaacatttattttgtatatgat

SEQ ID NO: 16 - DNA, 4947 bp, Artificial Sequence
  Plasmid sequence: PBAD::ftn::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 17 - DNA, 4929 bp, Artificial Sequence
  Plasmid sequence: PBAD::bfr::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 18 - DNA, 4710 bp, Artificial Sequence
  Plasmid sequence: PBAD::bfr::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 19 - DNA, 4766 bp, Artificial Sequence
  Plasmid sequence: PBAD::GFP::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctaggaggaacaaagatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataaatgtgtcacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 20 - DNA, 10458 bp, Artificial Sequence
  Plasmid sequence: PBAD::GFP::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccgcacaatctgccctttcgaaagatcccaacgaaaagagagaccacatggtccttcttgagtttgtaacagctgctgggattacacatggcatggatgaactatacaaataaatgtgtcgacaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 21 - DNA, 9717 bp, Artificial Sequence
  Plasmid sequence: PBAD::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 22 - DNA, 4089 bp, Artificial Sequence
  Plasmid sequence: PS10::bfr::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 23 - DNA, 4107 bp, Artificial Sequence
  Plasmid sequence: PS10::ftn::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggctaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 24 - DNA, 3870 bp, Artificial Sequence
  Plasmid sequence: PS10::bfr::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 25 - DNA, 3926 bp, Artificial Sequence
  Plasmid sequence: PS10::GFP::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggctaggaggaacaaagatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataaatgtgtcacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 26 - DNA, 9618 bp, Artificial Sequence
  Plasmid sequence: PS10::GFP::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggctaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccgcacaatctgccctttcgaaagatcccaacgaaaagagagaccacatggtccttcttgagtttgtaacagctgctgggattacacatggcatggatgaactatacaaataaatgtgtcgacaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 27 - DNA, 8877 bp, Artificial Sequence
  Plasmid sequence: PS10::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtttaaactcgaaacagtattatcaagaacttgaggcacctgaaaagcgctggtttcaatttgagaattcagctcacaccccgcatattgaggagccatcattattcgcgaacacattaagtcggcatgcacgcaaccatttatgatagatccttgataaataagaaaaacccctgtataataaaaaaagtgtgcaaatgatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagactgtctaacgtgatgtaggcgcaaaacaagtttgtacaaaaaagcaggctaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 28 - DNA, 3832 bp, Artificial Sequence
  Plasmid sequence: PxylA::bfr::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 29 - DNA, 3850 bp, Artificial Sequence
  Plasmid sequence: PxylA::ftn::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 30 - DNA, 3613 bp, Artificial Sequence
  Plasmid sequence: PxylA::bfr::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggcttaaaaaggaggaataaaaaatgaaaggtgatactaaagttataaattatctcaacaaactgttgggaaatgagcttgtcgcaatcaatcagtactttctccatgcccgaatgtttaaaaactggggtctcaaacgtctcaatgatgtggagtatcatgaatccattgatgagatgaaacacgccgatcgttatattgagcgcattctttttctggaaggtcttccaaacttacaggacctgggcaaactgaacattggtgaagatgttgaggaaatgctgcgttctgatctggcacttgagctggatggcgcgaagaatttgcgtgaggcaattggttatgccgatagcgttcatgattacgtcagccgcgatatgatgatagaaattttgcgtgatgaagaaggccatatcgactggctggaaacggaacttgatctgattcagaagatgggcctgcaaaattatctgcaagcacagatccgcgaagaaggttgacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 31 - DNA, 3669 bp, Artificial Sequence
  Plasmid sequence: PxylA::GFP::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctaggaggaacaaagatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataaatgtgtcacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 32 - DNA, 9361 bp, Artificial Sequence
  Plasmid sequence: PxylA::GFP::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccgcacaatctgccctttcgaaagatcccaacgaaaagagagaccacatggtccttcttgagtttgtaacagctgctgggattacacatggcatggatgaactatacaaataaatgtgtcgacaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 33 - DNA, 8620 bp, Artificial Sequence
  Plasmid sequence: PxylA::luxABCDE::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 34 - DNA, 4089 bp, Artificial Sequence
  Plasmid sequence: PompA::SA-B1/ompA::rrnBT1T2
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggatcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagcgtctggaaatttgccagaatgtgtgctattatctgggcaccctgaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 35 - DNA, 4089 bp, Artificial Sequence
  Plasmid sequence: PompA::SA-B3/ompA
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggatcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaccgtgctgatttgcatgaatatttgctggaccggcgaaacccagaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

SEQ ID NO: 36 - DNA, 4275 bp, Artificial Sequence
  Plasmid sequence: PompA::SA-B3/ompA::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggatcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaccgtgctgatttgcatgaatatttgctggaccggcgaaacccagaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 37 - DNA, 4494 bp, Artificial Sequence
  Plasmid sequence: PompA::SA-B3/ompA::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggatcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaccgtgctgatttgcatgaatatttgctggaccggcgaaacccagaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 38 - DNA, 4441 bp, Artificial Sequence
  Plasmid sequence: PxylA::SA-B3/ompA::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaccgtgctgatttgcatgaatatttgctggaccggcgaaacccagaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 39 - DNA, 5319 bp, Artificial Sequence
  Plasmid sequence: PBAD::SA-3/ompA::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaccgtgctgatttgcatgaatatttgctggaccggcgaaacccagaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 40 - DNA, 5541 bp, Artificial Sequence
  Plasmid sequence: PBAD::SPep/ompA::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaaggaaactgcagcagccaagtttgagcggcagcacatggactccagcaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 41 - DNA, 4444 bp, Artificial Sequence
  Plasmid sequence: PxylA::SPep/ompA::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaaggaaactgcagcagccaagtttgagcggcagcacatggactccagcaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 42 - DNA, 4278 bp, Artificial Sequence
  Plasmid sequence: PompA::Spep/ompA::ftn
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgtgacggagttcacacttgtaagttttcaactacgttgtagactttacatcgccaggggtgctcggcataagccgaagatatcggtagagttaatattgagcagatcccccggtgaaggatttaaccgtgttatctcgttggagatattcatggcgtattttggatcaagtttgtacaaaaaagcaggctgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggcctgatcggccagaaggaaactgcagcagccaagtttgagcggcagcacatggactccagcaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacctggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaaacccagctttcttgtacaaagtggaaggaggaataaaaaatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaacaacttt

SEQ ID NO: 43 - protein, 15 aa, Artificial Sequence
  Bovine S-peptide sequence
KETAAAKFERQHMDS

SEQ ID NO: 44 - DNA, 148 bp, Artificial Sequence
  LIVP F3
aatatagcaacagtagttcttgctcctccttgattctagcatcctcttcattattttcttctacgtacataaacatgtccaatacgttagacaacacaccgacgatggcggccgctacagacacgaatatgactaaaccgatgaccat

SEQ ID NO: 45 - protein, 49 aa, Artificial Sequence
  LIVP F3
MVIGLVIFVSVAAAIVGVLSNVLDMFMYVEENNEEDARIKEEQELLLLY

SEQ ID NO: 46 - DNA, 19 bp, Artificial Sequence
  fur consensus sequence
gataatgataatcattatc

SEQ ID NO: 47 - DNA, 190167 bp, Vaccinia virus
  Lister strain LIVP
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 48 - protein, 15 aa, Artificial Sequence
  Human S-peptide sequence
KESRAKKFQRQHMDS

SEQ ID NO: 49 - protein, 15 aa, Artificial Sequence
  SA-B1
RLEICQNVCYYLGTL

SEQ ID NO: 50 - protein, 15 aa, Artificial Sequence
  SA-B3a
TVLICMNICWTGETQ

SEQ ID NO: 51 - protein, 15 aa, Artificial Sequence
  SA-B3b
GVLICMNICWTGETQ

SEQ ID NO: 52 - protein, 165 aa, Escherichia coli
  Ferritin (ftn/rsgA)
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 53 - protein, 158 aa, Escherichia coli
  Bacteriaferritin (bfr)
MKGDTKVINYLNKLLGNELVAINQYFLHARMFKNWGLKRLNDVEYHESIDEMKHADRYIERILFLEGLPNLQDLGKLNIGEDVEEMLRSDLALELDGAKNLREAIGYADSVHDYVSRDMMIEILRDEEGHIDWLETELDLIQKMGLQNYLQAQIREEG

SEQ ID NO: 54 - protein, 238 aa, Artificial Sequence
  EGFP3
MSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 55 - protein, 360 aa, Artificial Sequence
  luxABCDE
MKFGNFLLTYQPPQFSQTEVMKRLVKLGRISEECGFDTVWLLEHHFTEFGLLGNPYVAAAYLLGATKKLNVGTAAIVLPTAHPVRQLEDVNLLDQMSKGRFRFGICRGLYNKDFRVFGTDMNNSRALAECWYGLIKNGVTEGYMEADNEHIKFHKVKVNPAAYSRGGAPVYVVAESASTTEWAAQFGLPMILSWIINTNEKKAQLELYNEVAQEYGHDIHNIDHCLSYITSVDHDSIKAKEICRKFLGHWYDSYVNATTIFDDSDQTRGYDFNKGQWRDFVLKGHKDTNRRIDYSYEINPVGTPQECIDIIQKDIDATGISNICCGFEANGTVDEIIASMKLFQSDVMPFLKEKQRSLLY

SEQ ID NO: 56 - DNA, 6395 bp, Artificial Sequence
  Plasmid pSB2030
cccgggttaacaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataaatgtgtcgacaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcatgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtcgccatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgttgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatggaatatacctaataggtaccaggaggaaggcaaatatgactaaaaaaatttcattcattattaacggccaggttgaaatctttcccgaaagtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgtattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcgacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaatgagaccgttgcaacgattagtgacatatatttctcatgaaaggccatctaactatacggctaaggatgttgcggttgaaatagaacagactcgattcctggaagaagataagttccttgtatttgtcccataataggtaaaagtatggaaaatgaatcaaaatataaaaccatcgaccacgttatttgtgttgaaggaaataaaaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccggataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagttgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttaccgatgatgtcgggataattagcagagaatatggtaagtatcccggcgtgctcgttgaaattttacgtcgcgtcaatacgaggacgcagaaagggtgtgctttaagcttaaccgaagcgtttgatagttgatatcctgcag

SEQ ID NO: 57 - DNA, 4107 bp, Artificial Sequence
  Plasmid pDESTR4-R3
caggaaacagctatgaccatgattacgccaagctatcaactttgtatagaaaagttgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggggactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcggcaaaagagccgttcatttcaataaaccgggcgacctcagccatcccttcctgattttccgctttccagcgttcggcacgcagacgacgggcttcattctgcatggttgtgcttaccgaaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccggatcctctagattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacggatcctaactcaaaatccacacattatacgagccggaagcataaagtgtaaagcctgggggtgcctaatgcggccgccatagtgactggatatgttgtgttttacagtattatgtagtctgttttttatgcaaaatctaatttaatatattgatatttatatcattttacgtttctcgttcaactttattatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcaca

SEQ ID NO: 58 - DNA, 4905 bp, Artificial Sequence
  Plasmid PBAD::dps::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctatgaaaacaatcaactcagtagacacaaaggaatttttgaatcaccaagtagcgaatttaaacgtattcacagtaaaaattcatcaaattcattggtatatgagaggccacaacttcttcactttacatgaaaaaatggatgatttatatagcgaattcggcgaacaaatggatgaagtagcagaacgtttactagcaatcggcggaagcccattctcgactttaaaagagtttttagaaaatgcgagcgtagaagaagcgccttatacaaaaccaaaaacaatggatcaattaatggaagacttagttggaacattagaattacttagagacgaatatcaacaaggtattgagcttactgacaaagaaggcgacaatgtaacaaacgatatgctaattgctttcaaagcaagcattgacaaacatatctggatgttcaaagcattcttaggaaaagctccattagagtagacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 59 - DNA, 3808 bp, Artificial Sequence
  Plasmid PxylA::dps::GFP
attatacatagttgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggtcttttgctggccttttgctcacatgttctttcctgcgttatcccctgattctgtggataaccgtattaccgcctttgagtgagctgataccagcggataacaatttcacacaggaaacagctatgaccatgattacgccaagctatcaactttgtatagaaaagttgaaacattgaaataaacatttattttgtatatgatgagataaagttagtttattggataaacaaactaactcaattaagatagttgatggataaacttgttcacttaaatcaacaagtttgtacaaaaaagcaggctatgaaaacaatcaactcagtagacacaaaggaatttttgaatcaccaagtagcgaatttaaacgtattcacagtaaaaattcatcaaattcattggtatatgagaggccacaacttcttcactttacatgaaaaaatggatgatttatatagcgaattcggcgaacaaatggatgaagtagcagaacgtttactagcaatcggcggaagcccattctcgactttaaaagagtttttagaaaatgcgagcgtagaagaagcgccttatacaaaaccaaaaacaatggatcaattaatggaagacttagttggaacattagaattacttagagacgaatatcaacaaggtattgagcttactgacaaagaaggcgacaatgtaacaaacgatatgctaattgctttcaaagcaagcattgacaaacatatctggatgttcaaagcattcttaggaaaagctccattagagtagacccagctttcttgtacaaagtggaaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaagagagaccacatggtccttcttgagtttgtaacagctgctgggattacacatggcatggatgaactatacaaataacaacttt

SEQ ID NO: 60 - protein, 156 aa, Artificial Sequence
  dps Listeria monocytogenes
MKTINSVDTKEFLNHQVANLNVFTVKIHQIHWYMRGHNFFTLHEKMDDLYSEFGEQMDEVAERLLAIGGSPFSTLKEFLENASVEEAPYTKPKTMDQLMEDLVGTLELLRDEYQQGIELTDKEGDNVTNDMLIAFKASIDKHIWMFKAFLGKAPLE

SEQ ID NO: 61 - DNA, 72 bp, Artificial Sequence
  E. coli lac promoter
taatgtgagttagctcactcattaggcaccccaggctttacactttatgcttccggctcgtatgttgtgtgg

SEQ ID NO: 62 - DNA, 42 bp, Artificial Sequence
  E. coli trp promoter
gagctgttgacaattaatcatcgaactagttaactagtacgc

SEQ ID NO: 63 - DNA, 40 bp, Artificial Sequence
  E. coli tac promoter
gagctgttgacaattaatcatcggctcgtataatgtgtgg

SEQ ID NO: 64 - protein, 362 aa, Artificial Sequence
  Spep/ompA
MKKTAIAIAVALAGFATVAQAAPKDNTWYTGAKLGWSQYHDTGLIGQKETAAAKFERQHMDSSNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 65 - DNA, 22 bp, Artificial Sequence
  Primer delmsbB5'f
cgatcgtcgcgaattcctggcg

SEQ ID NO: 66 - DNA, 23 bp, Artificial Sequence
  Primer delmsbB3'r
cgttacgccggtgcactttgata

SEQ ID NO: 67 - DNA, 34 bp, Artificial Sequence
  Primer DmsbB1(SalI)
cgtcgcgtcgacctggcgcaggccaaagagattg

SEQ ID NO: 68 - DNA, 42 bp, Artificial Sequence
  Primer DmsbB2(EcoRI)
agaggcttttttagaattccatgcttttccagtttcggataa

SEQ ID NO: 69 - DNA, 39 bp, Artificial Sequence
  Primer DmsbB3(EcoRI)
ctggaaaagcatggaattctaaaaaagcctctcgcgagg

SEQ ID NO: 70 - DNA, 33 bp, Artificial Sequence
  Primer DmsbB4(SalI)
acgccggtcgactttgatagcgctaatgacggc

SEQ ID NO: 71 - DNA, 2665 bp, Escherichia coli
  ChuA complete cds
  ref <308>: DATABASE ACCESSION NUMBER: U67920
  ref <309>: DATABASE ENTRY DATE: 1997-02-22
atcgaggcttgcagagcaaagagaagaaaaaattatcactgttaacgacaaaatttagtgatgaggcatggggggataaccataaaaacaaggtggtttacagggcgcaggataggtttcataaccccctgtttattgtgttaatggtggttaaaaaaaaacttgatcataaaaaattgatcgataataattctcattatcacgtttgcatttaacaaaacacgaccatatggataacaaaaccatagcatttgcaagggataacgcacagctctcttcactcctgatggggcatatcgttttgcctgacaaagagggcgtgcttttgcgtaattgccgagttatcaggcaatttcatgggatataaacgcctgtaaactcacccgacgaatattatcgctctgaattttaaataaatttatttttcgccagccaccccggtattaacccaggcagccagcattttttattttcctcatggagaatcgctatgtcacgtccgcaatttacctcgttgcgtttgagtttattggccttagctgtttctgccaccttgccaacgtttgcttttgctactgaaaccatgaccgttacggcaacggggaatgcccgtagttccttcgaagcgcctatgatggtcagcgtcatcgacacttccgctcctgaaaatcaaacggctacttcagccaccgatctgctgcgtcatgttcctggaattactctggatggtaccggacgaaccaacggtcaggatgtaaatatgcgtggctatgatcatcgcggcgtgctggttcttgtcgatggtgttcgtcagggaacggataccggacacctgaatggcacttttctcgatccggcgctgatcaagcgtgttgagattgttcgtggaccttcagcattactgtatggcagtggcgcgctgggtggagtgatctcctacgatacggtcgatgcaaaagatttattgcaggaaggacaaagcagtggttttcgtgtctttggtactggcggcacgggggaccatagcctgggattaggcgcgagcgcgtttgggcgaactgaaaatctggatggtattgtggcctggtccagtcgcgatcggggtgatttacgccagagcaatggtgaaaccgcgccgaatgacgagtccattaataacatgctggcgaaagggacctggcaaattgattcagcccagtctctgagcggtttagtgcgttactacaacaacgacgcgcgtgaaccaaaaaatccgcagaccgttggggcttctgaaagcagcaacccgatggttgatcgttcaacaattcaacgcgatgcgcagctttcttataaactcgccccgcagggcaacgactggttaaatgcagatgcaaaaatttattggtcggaagtccgtattaatgcgcaaaacacggggagttccggcgagtatcgtgaacagataacaaaaggagccaggctggagaaccgttccactctctttgccgacagtttcgcttctcacttactgacatatggcggtgagtattatcgtcaggaacaacatccgggcggcgcgacgacgggcttcccgcaagcaaaaatcgattttagctccggctggctacaggatgagatcaccttacgcgatctgccgattaccctgcttggcggaacccgctatgacagttatcgcggtagcagtgacggttacaaagatgttgatgccgacaaatggtcatctcgtgcggggatgactatcaatccgactaactggctgatgttatttggctcatatgcccaggcattccgcgccccgacgatgggcgaaatgtataacgattctaagcacttctcgattggtcgcttctataccaactattgggtgccaaacccgaacttacgtccggaaactaacgaaactcaggagtacggttttgggctgcgttttgatgacctgatgttgtccaatgatgctctggaatttaaagccagctactttgataccaaagcgaaggattacatctccacgaccgtcgatttcgcggcggcgacgactatgtcgtataacgtcccgaacgccaaaatctggggctgggatgtgatgacgaaatataccactgatctgtttagccttgatgtggcctataaccgtacccgcggcaaagacaccgataccggcgaatacatctccagcattaacccggatactgttaccagcactctgaatattccgatcgctcacagtggcttctctgttgggtgggttggtacgtttgccgatcgctcaacacatatcagcagcagttacagcaaacaaccaggctatggcgtgaatgatttctacgtcagttatcaaggacaacaggcgctcaaaggtatgaccactactttggtgttgggtaacgctttcgacaaagagtactggtcgccgcaaggcatcccacaggatggtcgtaacggaaaaattttcgtgagttatcaatggtaatcatctgccccgatatttcggggcatttatctggaaggaagagagacaatgaaccactacacacgctggcttgagttaaaagaacaaaatcccggaaagtacgtgcgtgacatcgcagggttaatgaatattagagaagcagaactggcatttgcacgagtcacgcacgatgcgtggcggatgcgcggcgat

SEQ ID NO: 72 - DNA, 203057 bp, Vaccinia virus
  GLV-1h68 genome
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggtggtggtgcaaatcaaagaactgctcctcagtggatgttgcctttacttctaggcctgtacggaagtgttacttctgctctaaaagctgctgcagggggggggggggggtgggggggccggttagggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtatcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaaaaaaaaaaaaaaaaaaaaaaaaaaaaaaaaaaaaaaaaaaaaaaaaaaaaaaaaaaaaaaaaagtaccttctgaggcggaaagaaccagccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcggtacccggggatcagcttgcatgcctgcagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacattctagtcgaggaattcatttatagcatagaaaaaaacaaaatgaaattctactatatttttacatacatatattctaaatatgaaagtggtgattgtgactagcgtagcatcgcttctagacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatccccgatccccgacctgcaggcatgcaagctcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 73 - DNA, 190167 bp, Vaccinia virus; identical to SEQ ID NO: 47
  LIVP genome (reconstituted from GLV-ih68 sequence)

SEQ ID NO: 74 - DNA, 9140 bp, Vaccinia virus
  TK region in GLV-1h22
atgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggctggttctttccgcctcagaaggtactttttttttttttttttttttttttttttttttttttttttttttttttttttttttttttttttttttttttttttttttcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagatactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctcgcaaaaacagaaagaaactgctgggattccagaatatgcaaggaaagggaaagcagcattgtctaaagtgagtttctcaactttgctggcccagttgctgtcctgatatagaaattgcccagtaaccggatgcttcacattttgcattgttttctcaataagcgtatacaacagtgggctggcagaaaccttgaagttgctggtaccaagaaccgctttatccagattaatataagtgaaagcctttaaatgcagggacgaaaggtatccctctagccattcagtggcaccaaccgatccaaagtctccagcactccaactggcaaagataatgcttctgctgggctgaaacccatcttttaagaccatatctgagaacatctgggcaagtttcaataggagagctgtgcctacaccggattttgcagctccagggccccatgcatctctctgggccccaactacaacatagtgatctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcatgtccaaagaatgaaagttctgcgttaacaatgggaaatttagtctggtccatgtatatcaacacaccaattgcatttaagctttcagcatttgcaaccttttctgcaaaggtgattttccctgctctgacaatcactatagatccattcacaggagtgtataaatcctcaaaatcttttttagtaccaaaattagcatggaccagtttaccagtaactgttgcagccttactatacgccacataacccccaggattctccaccaggtaaacaagtctaccgttcttatcaactatgatcaccgagttttgagcgctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcttgatggtgctggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaacaagttagagaatgctgatctagcttgatccatcattctgaactgccacacagaagaacactagcgcgtcctccgtcccgagccgccacccgatatcccgacgctctgaggggatggcggccctaaccggcccccccaccccccccccccccctgcagcagcttttagagcagaagtaacacttccgtacaggcctagaagtaaaggcaacatccactgaggagcagttctttgatttgcaccaccaccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataa

SEQ ID NO: 75 - DNA, 4348 bp, Artificial Sequence
  pNCVVhaT-ftn
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttaaaaattgaaattttattttttttttttggaatataaataccatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 76 - DNA, 498 bp, Escherichia coli
  DNA encoding E. coli ferritin (ftn)
atgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaa

SEQ ID NO: 77 - DNA, 40 bp, Artificial Sequence
  synthetic early/late promoter PSEL
aaaaattgaaattttattttttttttttggaatataaata

SEQ ID NO: 78 - DNA, 78 bp, Artificial Sequence
  Primer 5`SSEL-ftn-VV3
aaagataagcttaaaaattgaaattttattttttttttttggaatataaataccatgctgaaaccagaaatgattgaa

SEQ ID NO: 79 - DNA, 33 bp, Artificial Sequence
  Primer 3`ftn-VV2
ataataggatccttagttttgtgtgtcgagggt

SEQ ID NO: 80 - DNA, 3812 bp, Artificial Sequence
  pNCVVhaT
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 81 - DNA, 12455 bp, Artificial Sequence
  pBR322\DEST PBAD-DUAL term
attatacatagttgataattcactggatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattctcatgtttgacagcttatcatcgataccatgattacgccaagctatcaactttgtatagaaaagttgttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaagtttgtacaaaaaagcaggctaggaggaataaaaaatgagtaaaggcgaagaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttcggttatggtgttcaatgctttgcgagatacccagatcatatgaaacagcatgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccgcacaatctgccctttcgaaagatcccaacgaaaagagagaccacatggtccttcttgagtttgtaacagctgctgggattacacatggcatggatgaactatacaaataaatgtgtcgacaggaggactctctatgaaatttggaaactttttgcttacataccaacctccccaattttctcaaacagaggtaatgaaacgtttggttaaattaggtcgcatctctgaggagtgtggttttgataccgtatggttactggagcatcatttcacggagtttggtttgcttggtaacccttatgtcgctgctgcatatttacttggcgcgactaaaaaattgaatgtaggaactgccgctattgttcttcccacagcccatccagtacgccaacttgaagatgtgaatttattggatcaaatgtcaaaaggacgatttcggtttggtatttgccgagggctttacaacaaggactttcgcgtattcggcacagatatgaataacagtcgcgccttagcggaatgctggtacgggctgataaagaatggcgtgacagagggatatatggaagctgataatgaacatatcaagttccataaggtaaaagtaaaccccgcggcgtatagcagaggtggcgcaccggtttatgtggtggctgaatcagcttcgacgactgagtgggctgctcaatttggcctaccgatgatattaagttggattataaatactaacgaaaagaaagcacaacttgagctttataatgaagtggctcaagaatatgggcacgatattcataatatcgaccattgcttatcatatataacatctgtagatcatgactcaattaaagcgaaagagatttgccggaaatttctggggcattggtatgattcttatgtgaatgctacgactatttttgatgattcagaccaaacaagaggttatgatttcaataaagggcagtggcgtgactttgtattaaaaggacataaagatactaatcgccgtattgattacagttacgaaatcaatcccgtgggaacgccgcaggaatgtattgacataattcaaaaagacattgatgctacaggaatatcaaatatttgttgtggatttgaagctaatggaacagtagacgaaattattgcttccatgaagctcttccagtctgatgtcatgccatttcttaaagaaaaacaacgttcgctattatattagctaaggagaaagaaatgaaatttggattgttcttccttaacttcatcaattcaacaactgttcaagaacaaagtatagttcgcatgcaggaaataacggagtatgttgataagttgaattttgaacagattttagtgtatgaaaatcatttttcagataatggtgttgtcggcgctcctctgactgtttctggttttctgctcggtttaacagagaaaattaaaattggttcattaaatcacatcattacaactcatcatcctgtccgcatagcggaggaagcttgcttattggatcagttaagtgaagggagatttattttagggtttagtgattgcgaaaaaaaagatgaaatgcatttttttaatcgcccggttgaatatcaacagcaactatttgaagagtgttatgaaatcattaacgatgctttaacaacaggctattgtaatccagataacgatttttatagcttccctaaaatatctgtaaatccccatgcttatacgccaggcggacctcggaaatatgtaacagcaaccagtcatcatattgttgagtgggcggccaaaaaaggtattcctctcatctttaagtgggatgattctaatgatgttagatatgaatatgctgaaagatataaagccgctgcggataaatatgacgttgacctatcagagatagaccatcagttaatgatattagttaactataacgaagatagtaataaagctaaacaagagacgcgtgcatttattagtgattatgttcttgaaatgcaccctaatgaaaatttcgaaaataaacttgaagaaataattgcagaaaacgctgtcggaaattatacggagtgtataactgcggctaagttggcaattgaaaagtgtggtgcgaaaagtgtattgctgtcctttgaaccaatgaatgatttgatgagccaaaaaaatgtaatcaatattgttgatgataatattaagaagtaccacatgaaatatacctaataggtacccggggatcctaataggtaccaggaggaaggcaaatatgactaaaaaaatttcattcattattaacggccaggttgagatctttcccgaaggtgatgatttagtgcaatccattaattttggtgataatagtgtttacctgccaatattgaatgactctcatgtaaaaaacattattgattgtaatggaaataacgaattacggttgcataacattgtcaattttctctatacggtagggcaaagatggaaaaatgaagaatactcaagacgcaggacatacattcgtgacttaaaaaaatatatgggatattcagaagaaatggctaagctagaggccaattggatatctatgattttatgttctaaaggcggcctttatgatgttgtagaaaatgaacttggttctcgccatatcatggatgaatggctacctcaggatgaaagttatgttcgggcttttccgaaaggtaaatctgtacatctgttggcaggtaatgttccattatctgggatcatgtctatattacgcgcaattttaactaagaatcagtgcattataaaaacatcgtcaaccgatccttttaccgctaatgcattagcgttaagttttattgatgtagaccctaatcatccgataacgcgctctttatctgttatatattggccccaccaaggtgatacatcactcgcaaaagaaattatgcaacatgcggatgttattgtcgcttggggagggccagatgcgattaattgggcggtagagcatgcgccatcttatgctgatgtgattaaatttggttctaaaaagagtctttgcattatcgataatcctgttgatttgacgtccgcagcgacaggtgcggctcatgatgtttgtttttacgatcagcgagcttgtttttctgcccaaaacatatattacatgggaaatcattatgaggaatttaagttagcgttgatagaaaaacttaatctatatgcgcatatattaccgaatgccaaaaaagattttgatgaaaaggcggcctattctttagttcaaaaagaaagcttgtttgctggattaaaagtagaggtggatattcatcaacgttggatgattattgagtcaaatgcaggtgtggaatttaatcaaccacttggcagatgtgtgtaccttcatcacgtcgataatattgagcaaatattgccttatgttcaaaaaaataagacgcaaaccatatctatttttccttgggagtcatcatttaaatatcgagatgcgttagcattaaaaggtgcggaaaggattgtagaagcaggaatgaataacatatttcgagttggtggatctcatgacggaacgagaccgttgcaacgattagtgacatatatttctcatgaaaggccatctaactatacggctaaggatgttgcggttgaaatagaacagactcgattcctggaagaagataagttccttgtatttgtcccataataggtaaaagtatgctagcttgtatttttaccaaggaggaataaaaaatggaaaatgaatcaaaatataaaaccatcgaccacgttatttgtgttgaaggaaataagaaaattcatgtttgggaaacgctgccagaagaaaacagcccaaagagaaagaatgccattattattgcgtctggttttgcccgcaggatggatcattttgctggtctggcggaatatttatcgcggaatggatttcatgtgatccgctatgattcgcttcaccacgttggattgagttcagggacaattgatgaatttacaatgtctataggaaagcagagcttgttagcagtggttgattggttaactacacgaaaaataaataacttcggtatgttggcttcaagcttatctgcgcggatagcttatgcaagcctatctgaaatcaatgcttcgtttttaatcaccgcagtcggtgttgttaacttaagatattctcttgaaagagctttagggtttgattatctcagtctacccattaatgaattgccgaataatctagattttgaaggccataaattgggtgctgaagtctttgcgagagattgtcttgattttggttgggaagatttagcttctacaattaataacatgatgtatcttgatataccgtttattgcttttactgcaaataacgataattgggtcaagcaagatgaagttatcacattgttatcaaatattcgtagtaatcgatgcaagatatattctttgttaggaagttcgcatgacttgagtgaaaatttagtggtcctgcgcaatttttatcaatcggttacgaaagccgctatcgcgatggataatgatcatctggatattgatgttgatattactgaaccgtcatttgaacatttaactattgcgacagtcaatgaacgccgaatgagaattgagattgaaaatcaagcaatttctctgtcttaaaggatcctgaggaggaaaacaggtatgacttcatatgttgataaacaagaaattacagcaagctcagaaattgatgatttgattttttcgagcgatccattagtgtggtcttacgacgagcaggaaaaaatcagaaagaaacttgtgcttgatgcatttcgtaatcattataaacattgtcgagaatatcgtcactactgtcaggcacacaaagtagatgacaatattacggaaattgatgacatacctgtattcccaacatcggtttttaagtttactcgcttattaacttctcaggaaaacgagattgaaagttggtttaccagtagcggcacgaatggtttaaaaagtcaggtggcgcgtgacagattaagtattgagagactcttaggctctgtgagttatggcatgaaatatgttggtagttggtttgatcatcaaatagaattagtcaatttgggaccagatagatttaatgctcataatatttggtttaaatatgttatgagtttggtggaattgttatatcctacgacatttaccgtaacagaagaacgaatagattttgttaaaacattgaatagtcttgaacgaataaaaaatcaagggaaagatctttgtcttattggttcgccatactttatttatttactctgccattatatgaaagataaaaaaatctcattttctggagataaaagcctttatatcataaccggaggcggctggaaaagttacgaaaaagaatctctgaaacgtgatgatttcaatcatcttttatttgatactttcaatctcagtgatattagtcagatccgagatatatttaatcaagctgaactcaacacttgtttctttgaggatgaaatgcagcgtaaacatgttccgccgtgggtatatgcgcgagcgcttgatcctgaaacgttgaaacctgtacctgatggaacgccggggttgatgagttatatggatgcgtcagcaaccagttatccagcatttattgttacccatgatgtcgggataattagcagagaatatggtaagtatcccggcgtgctcgttgaaattttacgtcgcgtcaatacgaggacgcagaaagggtgtgctttaagcttaaccgaagcgtttgatagttgaacccagctttcttgtacaaagtggaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccagtttaaacaacttt

The invention claimed is:

1. A method for detecting a site of proliferation or a proliferative condition in a subject, comprising:
administering an *E. coli* strain Nissle bacterium to a subject, wherein:
the subject has, is at risk of having or is suspected of having a proliferative condition; and
the Nissle bacterium expresses or accumulates a detectable molecule or a molecule that induces or produces a detectable signal; and
after a sufficient time for the Nissle bacterium to accumulate in proliferating tissues, detecting the detectable molecule or detectable signal to detect accumulation of Nissle bacterium in the subject, whereby detection of the Nissle bacterium indicates the site of proliferation or proliferative condition.

2. The method of claim 1, wherein the Nissle strain is 1917.

3. The method of claim 1, wherein the site of proliferation or the proliferative condition is selected from among a tumor, tumor tissue, wound, wound tissue, site of inflammation and inflamed tissue.

4. The method of claim 1, wherein the Nissle bacterium is modified, whereby it does not contain plasmid pMut1 and/or pMut2.

5. The method of claim 1, wherein the Nissle bacterium is administered systemically.

6. The method of claim 5, wherein the Nissle bacterium is administered intravenously.

7. The method of claim 1, wherein the Nissle bacterium is modified, whereby it does not express lipid acyl A transferase.

8. The method of claim 1, wherein the Nissle bacterium is modified, whereby it does not express lipopolysaccharide (LPS) or expresses LPS that lacks the myristic acid moiety of lipid A.

9. The method of claim 1, wherein the Nissle bacterium can be visualized in the subject.

10. The method of claim 1, wherein the Nissle bacterium can be visualized externally to the subject.

11. The method of claim 1, wherein the detectable molecule or the detectable signal is detectable by magnetic resonance imaging (MRI), single-photon emission computed tomography (SPECT), positron emission tomography (PET), scintigraphy, gamma camera, a $\beta^+$ detector a $\gamma$ detector, fluorescence imaging or bioluminescence imaging.

12. The method of claim 1, wherein the Nissle bacterium produces detectable electromagnetic radiation.

13. The method of claim 12, wherein the electromagnetic radiation is light.

14. The method of claim 1, wherein the Nissle bacterium comprises a heterologous nucleic acid encoding the detectable molecule or the molecule that induces a detectable signal.

15. The method of claim 14, wherein the detectable molecule or the detectable signal can be detected by magnetic resonance imaging (MRI), single-photon emission computed tomography (SPECT), positron emission tomography (PET), scintigraphy, gamma camera, a $\beta^+$ detector a $\gamma$ detector, fluorescence imaging or bioluminescence imaging.

16. The method of claim 14, wherein the nucleic acid encodes a gene product that can bind a contrast agent, chromophore or a compound or ligand for visualization of the Nissle bacterium.

17. The method of claim 14, wherein the nucleic acid encodes a fluorescent or luminescent protein.

18. The method of claim 17, wherein the nucleic acid encodes a luciferase.

19. The method of claim 18, wherein the Nissle bacterium further comprises a heterologous nucleic acid encoding one or more enzymes for the production of a substrate for the luciferase.

20. The method of claim 14, wherein the detectable molecule or a molecule that induces a detectable signal is a protein that is expressed on the surface of the Nissle bacterium.

21. The method of claim 20, wherein the protein comprises a fusion of a bacterial outer membrane protein and a detectable peptide located within an extracellular domain of the outer membrane protein.

22. The method of claim 21, wherein the bacterial outer membrane protein is an *Escherichia coli* OmpA protein or an *Escherichia coli* OmpC protein.

23. The method of claim 21, wherein the peptide is a streptavidin-binding peptide or an S peptide.

24. The method of claim 1, wherein the Nissle bacterium expresses a siderophore uptake protein.

25. The method of claim 1, further comprising administering to the subject a ligand for detection of the Nissle bacterium.

26. The method of claim 25, wherein the Nissle bacterium expresses a siderophore uptake protein; and the ligand interacts with the siderophore uptake protein.

27. The method of claim 26, wherein the ligand comprises a detectable moiety.

28. The method of claim 26, wherein the ligand is a siderophore.

29. The method of claim 28, wherein the siderophore is complexed with a metal.

30. The method of claim 28, further comprising administering to the subject a metal that complexes with the siderophore.

31. The method of claim 29, wherein the metal is selected from among iron, gallium, gadolinium, manganese, cobalt, zinc, chromium, gold and indium.

32. The method of claim 30, wherein the metal is selected from among iron, gallium, gadolinium, manganese, cobalt, zinc, chromium, gold and indium.

33. The method of claim 27, wherein the detectable moiety is a radionuclide.

34. The method of claim 33, wherein the radionuclide is selected from among $^{11}$Carbon, $^{13}$Carbon, $^{15}$Nitrogen, $^{18}$Fluorine, $^{19}$Fluorine, $^{32}$Phosphorus, $^{60}$Cobalt, $^{90}$Yttrium, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth, $^{213}$Bismuth, $^{67}$Gallium and $^{68}$Gallium, $^{241}$Am, $^{51}$Cr, $^{57}$Co, $^{58}$Co, $^{64}$Cu, $^{153}$Gd, $^{59}$Fe and $^{55}$Fe.

35. The method of claim 27, wherein the detectable moiety is $Eu^{3+}$.

36. The method of claim 27, wherein the detectable moiety emits light.

37. The method of claim 36, wherein the detectable moiety is a fluorescent or luminescent moiety.

38. The method of claim 24, wherein the siderophore uptake protein is an endogenous protein expressed by the Nissle bacterium.

39. The method of claim 24, wherein the Nissle bacterium comprises a heterologous nucleic acid encoding the siderophore uptake protein.

40. The method of claim 38, wherein the siderophore uptake protein is FepA protein, IroN protein, FyuA protein or IutA protein.

41. The method of claim 39, wherein the siderophore uptake protein is FepA protein, IroN protein, FyuA protein or IutA protein.

42. The method of claim 38, wherein the Nissle bacterium does not produce a siderophore that interacts with the siderophore uptake protein.

43. The method of claim 39, wherein the Nissle bacterium does not produce a siderophore that interacts with the siderophore uptake protein.

44. The method of claim 38, wherein the expression of the siderophore uptake protein is not repressed by iron.

45. The method of claim 39, wherein the expression of the siderophore uptake protein is not repressed by iron.

46. The method of claim 26, wherein the ligand is enterobactin, salmochelin, yersiniabactin or aerobactin.

47. The method of claim 24, wherein the Nissle bacterium expresses two or more different siderophore uptake proteins.

48. The method of claim 47, further comprising administering to the subject two or more different ligands wherein each of the ligands interacts with a siderophore uptake protein expressed by the Nissle bacterium.

49. The method of claim 1, wherein the Nissle bacterium further comprises one or more heterologous nucleic acid molecules encoding one or more proteins for the production of an iron acquisition molecule, an iron storage molecule, an iron metabolism molecule or an iron transport molecule.

50. The method of claim 49, wherein the iron acquisition molecule, iron storage molecule, iron metabolism molecule or iron transport molecule moves between the intracellular and extracellular environments of the Nissle bacterium and forms a complex with iron.

51. The method of claim 49, wherein the heterologous nucleic acid encodes one or more proteins for the production of a siderophore.

52. The method of claim 49, wherein the heterologous nucleic acid encodes a ferritin or a ferritin-like molecule or a rubrerythrin.

53. The method of claim 52, wherein the ferritin comprises a heavy subunit and/or a light subunit.

54. The method of claim 52, wherein the ferritin is a prokaryotic or eukaryotic ferritin.

55. The method of claim 54, wherein the prokaryotic ferritin is bacterioferritin or dodecameric ferritin.

56. The method of claim 49, wherein the heterologous nucleic acid encodes a heme-binding protein or a hemophore.

57. The method of claim 49, wherein the heterologous nucleic acid encodes a ferric dicitrate transporter protein.

58. The method of claim 49, further comprising administering to the subject a metal that complexes with the iron acquisition molecule, iron storage molecule, iron metabolism molecule or iron transport molecule.

59. The method of claim 58, wherein the metal is selected from among iron, gallium, gadolinium, manganese, cobalt, zinc, chromium, gold and indium.

60. The method of claim 58, wherein the metal is a radionuclide.

61. The method of claim 60, wherein the metal is selected from among $^{60}$Cobalt, $^{90}$Yttrium, $^{99}$Technetium, $^{103}$Palladium, $^{106}$Ruthenium, $^{111}$Indium, $^{117}$Lutetium, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth, $^{213}$Bismuth, $^{67}$Gallium and $^{68}$Gallium, $^{241}$Am, $^{51}$Cr, $^{57}$Co, $^{58}$Co, $^{64}$Cu, $^{153}$Gd, $^{59}$Fe and $^{55}$Fe.

62. The method of claim 49, wherein production of the iron acquisition molecule, iron storage molecule, iron metabolism molecule or iron transport molecule is not regulated by iron.

63. The method of claim 14, wherein the heterologous nucleic acid is operably linked to an inducible promoter.

64. The method of claim 63, wherein the promoter is a sugar-inducible promoter.

65. The method of claim 60, wherein the promoter is inducible by arabinose or xylose.

66. The method of claim 64, further comprising administering to the subject an inducer molecule, whereby the sugar-inducible promoter is activated.

67. The method of claim 66, wherein the inducer molecule is arabinose or xylose.

68. The method of claim 66, wherein the inducer molecule is administered systemically.

69. The method of claim 66, wherein the inducer molecule is administered intravenously or orally.

70. The method of claim 65, wherein one or more genes in the Nissle bacterium are modified, whereby the Nissle bacterium does not metabolize L-arabinose.

71. The method of claim 49, wherein one or more of the heterologous nucleic acid(s) is operably linked to an inducible promoter.

72. The method of claim 71, wherein the promoter is a sugar-inducible promoter.

73. The method of claim 72, wherein the promoter is inducible by arabinose or xylose.

74. The method of claim 73, further comprising administering to the subject an inducer molecule, whereby the sugar-inducible promoter is activated.

75. The method of claim 74, wherein the inducer molecule is arabinose or xylose.

76. The method of claim 74, wherein the inducer molecule is administered systemically.

77. The method of claim 74, wherein the inducer molecule is administered intravenously or orally.

78. The method of claim 73, wherein one or more genes in the Nissle bacterium are modified, whereby the Nissle bacterium does not metabolize L-arabinose.

79. The method of claim 1, wherein one or more genes in the Nissle strain are modified wherein:
the one or more genes are negatively regulated by iron in the absence of the modification; and
the modification is a mutation or deletion of one or more consensus nucleotide binding sites for the Fur protein in the promoter of the gene(s), whereby the gene(s) are not negatively regulated by iron.

80. The method of claim 1, wherein the Nissle bacterium comprises a nucleic acid encoding a therapeutic gene product.

81. The method of claim 80, wherein the therapeutic gene product is selected from among a cytokine, a chemokine, an immunomodulatory molecule, a single chain antibody, antisense RNA, prodrug converting enzyme, siRNA, angiogenesis inhibitor, a toxin, an antitumor oligopeptide, an antimitotic oligopeptide, an anti-cancer polypeptide antibiotic, and tissue factor.

82. The method of claim 1, wherein the method further comprises administering an anti-tumor or anti-cancer agent to the subject.

83. The method of claim 1, wherein the step of detecting comprises PET, SPECT, MRI or autoradiography.

84. The method of claim 16, wherein the gene product is an enzyme that binds to a detectable compound.

85. The method of claim 84, wherein the detectable compound is labeled with a radionuclide.

86. The method of claim 85, wherein the radionuclide is selected from among $^{11}$C, $^{13}$C, $^{13}$N, $^{15}$N, $^{15}$O, $^{18}$F, $^{19}$F, $^{32}$P, $^{52}$Fe, $^{51}$Cr, $^{55}$Co, $^{55}$Fe, $^{57}$Co, $^{58}$Co, $^{57}$Ni, $^{59}$Fe, $^{60}$Co, $^{64}$Cu, $^{67}$Ga, $^{68}$Ga, $^{60}$Cu(II), $^{67}$Cu(II), $^{67}$Ga, $^{68}$Ga, $^{99}$Tc, $^{90}$Y, $^{103}$Pd, $^{106}$Ru, $^{111}$In, $^{117}$Lu, $^{123}$I, $^{125}$I, $^{131}$I, $^{137}$Cs, $^{153}$Gd, $^{153}$Sm, $^{186}$Re, $^{188}$Re, $^{192}$Ir, $^{198}$Au, $^{211}$At, $^{212}$Bi, $^{213}$Bi and $^{241}$Am.

87. The method of claim 84, wherein the detectable compound is a metabolic compound.

88. The method of claim 87, wherein the detectable compound is $^{18}$F-FDG.

89. The method of claim 84, wherein the compound is detectable by positron emission tomography, single-photon emission computed tomography (SPECT) or a gamma camera.

90. The method of claim 84, wherein the compound is detected externally to the subject.

91. The method of claim 1, wherein the proliferative condition is a tumor or metastasis.

* * * * *

UNITED STATES PATENT AND TRADEMARK OFFICE
CERTIFICATE OF CORRECTION

PATENT NO. : 7,763,420 B2  Page 1 of 1
APPLICATION NO. : 11/827518
DATED : July 27, 2010
INVENTOR(S) : Stritzker et al.

It is certified that error appears in the above-identified patent and that said Letters Patent is hereby corrected as shown below:

IN THE TITLE PAGES:
In Item (56) References Cited, please add to the list of U.S. PATENT DOCUMENTS
--5,364,773 A  11/1994 Paoletti et al............435/69.1--;
In Item (56) References Cited, please add to the list of U.S. PATENT DOCUMENTS
--2006/0099224 A1  5/2006 Kirn...........424/199.1--.

At column 5, line 23, please replace "06 serotype" with --O6 serotype--.

Column 161, line 40 to line 45 should read:
    11.  The method of claim 1, wherein the detectable molecule or the detectable signal is detectable by magnetic resonance imaging (MRI), single-photon emission computed tomography (SPECT), positron emission tomography (PET), scintigraphy, gamma camera, a $\beta^+$ detector, a $\gamma$ detector, fluorescence imaging or bioluminescence imaging.
    Column 161, line 54 to line 59 should read:
    15.  The method of claim 14, wherein the detectable molecule or the detectable signal can be detected by magnetic resonance imaging (MRI), single-photon emission computed tomography (SPECT), positron emission tomography (PET), scintigraphy, gamma camera, a $\beta^+$ detector, a $\gamma$ detector, fluorescence imaging or bioluminescence imaging.

Signed and Sealed this

Twelfth Day of October, 2010

David J. Kappos
*Director of the United States Patent and Trademark Office*

UNITED STATES PATENT AND TRADEMARK OFFICE
CERTIFICATE OF CORRECTION

PATENT NO. : 7,763,420 B2  
APPLICATION NO. : 11/827518  
DATED : July 27, 2010  
INVENTOR(S) : Stritzker et al.

Page 1 of 1

It is certified that error appears in the above-identified patent and that said Letters Patent is hereby corrected as shown below:

IN THE SPECIFICATION:

At column 86, line 59-60, please replace "pseudomonas A endotoxin" with
-- Pseudomonas exotoxin --

Signed and Sealed this
Seventeenth Day of September, 2013

Teresa Stanek Rea
*Deputy Director of the United States Patent and TrademarkOffice*